United States Patent 12,565,641 (ENGINEERED TERMINAL DEOXYNUCLEOTIDYL TRANSFERASE VARIANTS) - sequence listing, part 3

SEQ ID NO: 5130 - protein, 394 aa, synthetic construct; identical to SEQ ID NO: 5080
  REGION 1..394: note = Variant of terminal deoxynucleotidyl transferase

SEQ ID NO: 5131 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgagccgcatgcagaaggcgggcttcctgtattacgaggatctggcgagcggtgttagtaaagaagaagccgatgccgttacgctcatcgtgaaggaaacggtgcgcactgttagtccggatgcgctggtgaccctggccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgcttcgcgtcggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5132 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLSRMQKAGFLYYEDLASGVSKEEADAVTLIVKETVRTVSPDALVTLAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRFASEERDMLLDNHRLYDLKKGIFLSADSEEEIFGHLDLDYLEPWERNA

SEQ ID NO: 5133 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggaaatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtatgaagctgagcaagatgcagaaggcgggcttcctgtattacgaggatctggcgagcggtgttagtaaagaagaagccgatgccgttacgctcatcgtgaaggaaacggtgcgccgcgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5134 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSMKLSKMQKAGFLYYEDLASGVSKEEADAVTLIVKETVRRVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5135 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgtcgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataaccgtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggaaccgtgggaacgcaacgcg

SEQ ID NO: 5136 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLSFEVTSMKDIQGLPCITDDVRPVIEEIIEVGESSRVKEILNDERYKAFKQFTSVFGVGVKTSEKWYRMGLRTREEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNRAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5137 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtagcttcgcggaggaagagcgcgacatgctgctcgacaaccatcgtctctacgacctgaaaaagggcatctttctgagtgcggacagcgaagaagagattttcggtcatctggacctggattatctggaaccgtgggaacgcaacgcg

SEQ ID NO: 5138 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRSFAEEERDMLLDNHRLYDLKKGIFLSADSEEEIFGHLDLDYLEPWERNA

SEQ ID NO: 5139 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5140 - protein, 394 aa, synthetic construct; identical to SEQ ID NO: 5092
  REGION 1..394: note = Variant of terminal deoxynucleotidyl transferase

SEQ ID NO: 5141 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataaccgtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgcttcgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5142 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNRAVGTSKKSDMAEVKDWKAVRVDLVVAPDEQFAYALLGWTGSGQFRRDTRRFAEEERDMLLDNHRLYDLKKGIFLSADSEEEIFGHLDLDYLEPWERNA

SEQ ID NO: 5143 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtagaagtagcaaaggccagtaagagtctgaagctgacccgcatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggaaccgtgggaacgcaacgcg

SEQ ID NO: 5144 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEVAKASKSLKLTRMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5145 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgcttcgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5146 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRFAEEERDMLLDNHRLYDLKKGIFLSADSEEEIFGHLDLDYLEPWERNA

SEQ ID NO: 5147 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggaaatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagagtctgatgctgagcaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacaaactggacaaccattcgaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5148 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKSLMLSKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDKLDNHSKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5149 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggttgaagaagcaaaggccagtaagcgcctgaagctgagcaagatgcagaaggcgggcttcctgtattacgaggatctggcgagcggtgttagtaaagaagaagccgatgccgttacggctatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctatgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5150 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEEAKASKRLKLSKMQKAGFLYYEDLASGVSKEEADAVTAIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5151 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5152 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5153 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctcgtggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5154 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPRGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5155 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5156 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5157 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctgcgtgccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5158 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLRAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5159 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgctatgaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctcgtggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgctctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagattcgcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5160 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTRYEAKASKSLKLNKMQKAGFLYYEDLASGVSKEEADAVTLIVKETVRTVSPDALVTIAGGFRRGKPRGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDSQFAYALLGWTGSGMFRRDTRRYAEEERDMLLDNHRLYDLKKGIFLSADSEEEIFGHLDLDYLEPWERNA

SEQ ID NO: 5161 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctgcgcagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggtggatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5162 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLRSGVSKEEADAVTLIVKETVRTVSPDALVTIAGGFRRGKPMGHDVDLLITIPGRPTDDELLHKVVDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5163 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttcgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5164 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVRTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVLDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5165 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctcgtggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgaacagttcgcctatgcgctgctcggttggacgggcagcggccagtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5166 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPRGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5167 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtaccaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5168 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYQDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5169 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcgctgaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctcgtggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5170 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACAEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPRGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5171 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctgcgcagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5172 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLRSGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5173 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttcgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5174 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVRTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5175 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctgactatcatggcggagaactacaagtttaaagagaacctgcaggcgtgcctggaagccaagaaagccgtgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatccagaggtgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5176 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALTIMAENYKFKENLQACLEAKKAVSVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDPEVLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5177 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctgcgtgccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5178 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLRAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5179 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcattaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5180 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5181 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctgcgtgccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcattcgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5182 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLRAKRAASVLKSLPFEVTSMKDIQGLPCITDDVRPVIEEIIEVGESSRVKEILNDERYKAFKQFTSVFGVGIRTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5183 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5184 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHGLYDLKKGIFLSADSEEEIFGHLDLDYLEPWERNA

SEQ ID NO: 5185 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttcgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5186 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVRTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5187 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcgctgaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5188 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACAEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5189 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggcggagaactacaagtttaaagagaacctgcaggcgtgcctggaagccaagcgtgccattagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatccagagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggagcgtgagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5190 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAISVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDPELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAERERDMLLDNHRLYDLKKGIFLSADSEEEIFGHLDLDYLEPWERNA

SEQ ID NO: 5191 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcattcgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtaccaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5192 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGIRTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYQDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5193 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5194 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5195 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcattcgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggtggatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5196 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGIRTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5197 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcattaaaacctcggaaaagtggtaccgtatgggcctccgtacgcgcgaagaagcaaaggccagtaagagtctgaagctgaacaagatgcagaaggcgggcttcctgtattacgaggatctgcgcagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5198 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLRSGVSKEEADAVTLIVKETVRTVSPDALVTIAGGFRRGKPMGHDVDLLITIPGRPTDDELLHKVLDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5199 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5200 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5201 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcattaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggtggatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5202 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHGLYDLKKGIFLSADSEEEIFGHLDLDYLEPWERNA

SEQ ID NO: 5203 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctgcgtgcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctgcgcagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5204 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLRARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLRSGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHGLYDLKKGIFLSADSEEEIFGHLDLDYLEPWERNA

SEQ ID NO: 5205 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5206 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVLDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5207 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggtggatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5208 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5209 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttcgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggtggatctgctcaagaagcaaggtctgctgctgtaccaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5210 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVRTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYQDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5211 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggtggatctgctcaagaagcaaggtctgctgctgtaccaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5212 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYQDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5213 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttcgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5214 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVRTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVLDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5215 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttcgtacctcggaaaagtggtaccgtatgggcctccgtacgcgcgaagaagcaaaggccagtaagagtctgaagctgaacaagatgcagaaggcgggcttcctgtattacgaggatctgcgcagcggcgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5216 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVRTSEKWYRMGLRTREEAKASKSLKLNKMQKAGFLYYEDLRSGVSKEEADAVTLIVKETVRTVSPDALVTIAGGFRRGKPMGHDVDLLITIPGRPTDDELLHKVLDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5217 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtaccaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5218 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVLDLLKKQGLLLYQDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHSLYDLKKGIFLSADSEEEIFGHLDLDYLEPWERNA

SEQ ID NO: 5219 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagattcgcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5220 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDSQFAYALLGWTGSGMFRRDTRRYAEEERDMLLDNHRLYDLKKGIFLSADSEEEIFGHLDLDYLEPWERNA

SEQ ID NO: 5221 - DNA, 1182 bp, synthetic construct; identical to SEQ ID NO: 5193
  misc_feature 1..1182: note = Variant of terminal deoxynucleotidyl transferase
  source 1..1182: mol_type = other DNA

SEQ ID NO: 5222 - protein, 394 aa, synthetic construct; identical to SEQ ID NO: 5194
  REGION 1..394: note = Variant of terminal deoxynucleotidyl transferase

SEQ ID NO: 5223 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5224 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5225 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagattcgcagttcgcctatgcgctgctcggttggacgggcagcggccagtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5226 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDSQFAYALLGWTGSGQFRRDTRRYAEEERDMLLDNHRLYDLKKGIFLSADSEEEIFGHLDLDYLEPWERNA

SEQ ID NO: 5227 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctgcgtgccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggtggatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5228 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLRAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHSLYDLKKGIFLSADSEEEIFGHLDLDYLEPWERNA

SEQ ID NO: 5229 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaaccgccaggcgtgcctggaagccaagcgcgccgcgagtgtcctgaaaagcctgccgttcgaggttaccagcatgaaagacatccaaggtctgccgtgcattaccgacgacgtacgtcctgttatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctcagggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5230 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENRQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPQGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5231 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggtggagaactacaagtttaaagagaacctgcaggcgtgcctggaagccaagcgtgccgtgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctgctcatcgtgaaggaaacggtgcgcactgttagtccggatgcgctggtgaccatcgccggcggtttccgccgtggcaaacctatgggccacgacgttgacctgctgatcacgattccgggccgtcctacggatgatgaggtgctccacaaagtggttgatctgctcaagaagcaaggtctgctgctgtacgaagacatccgtgagagcacgttcgtggaggggcaactgccaaatcctaaacctgacgccctggacaaccatcaaaagtgtttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaggagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5232 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMVENYKFKENLQACLEAKRAVSVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLLIVKETVRTVSPDALVTIAGGFRRGKPMGHDVDLLITIPGRPTDDEVLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5233 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctgcgtgcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5234 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLRARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5235 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatggacctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccagtttcgtcgcgatactcgtcgctacgcggaggaagagcgcgacatgctgctcgacaaccatagtctctacgacctgaaaaagggcatctttctgagtgcggacagcgaagaagagattttcggtcatctggacctggattatctggagccgtgggaacgcaacgcg

SEQ ID NO: 5236 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMDLRTREEAKASKSLKLNKMQKAGFLYYEDLASGVSKEEADAVTLIVKETVRTVSPDALVTIAGGFRRGKPMGHDVDLLITIPGRPTDDELLHKVLDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHSLYDLKKGIFLSADSEEEIFGHLDLDYLEPWERNA

SEQ ID NO: 5237 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctgcgtgcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcattaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtacgaagacatccgtgagcgcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5238 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLRARRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVLDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5239 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggtggagaactacaagtttaaagagaacctgcaggcgtgcctggaagccaagcgtgccattagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtagaagtagcaaaggccagtaagagtctgaagctgaacaagatgcagaaggcgggcttcctgtattacgaggatctggcgagcggtgttagtaaagaagaagccgatgccgttctgctcatcgtgaaggaaacggtgcgcactgttagtccggatgcgctggtgaccatcgccggcggtttccgccgtggcaaacctatgggccacgacgttgacctgctgatcacgattccgggccgtcctacggatgatgaggtgctccacaaagtggttgatctgctcaagaagcaaggtctgctgctgtacgaagacatccgtgagagcacgttcgtggaggggcaactgccaaatcctaaacctgacgccctggacaaccatgggaagatgttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5240 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMVENYKFKENLQACLEAKRAISVLKSLPFEVTSMKDIQGLPCITDDVRPVIEEIIEVGESSRVKEILNDERYKAFKQFTSVFGVGVKTSEKWYRMGLRTVEVAKASKSLKLNKMQKAGFLYYEDLASGVSKEEADAVLLIVKETVRTVSPDALVTIAGGFRRGKPMGHDVDLLITIPGRPTDDEVLHKVVDLLKKQGLLLYEDIRESTFVEGQLPNPKPDALDNHGKMFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5241 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagattatggtggagaactacaagtttaaagagaacctgcaggcgtgcctggaagccaagcgtgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttcagctcatcgtgaaggaaacggtgcgcactgttagtccggatgcgctggtgaccatcgccggcggtttccgccgtggcaaacctatgggccacgacgttgacctgctgatcacgattccgggccgtcctacggatgatgagctgctccacaaagtggttgatctgctcaagaagcaaggtctgctgctgtacgaagacatccgtgagagcacgttcgtggaggggcaactgccaaatcctaaacctgacgccctggacaaccatcaaaagatgttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggagattgagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5242 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMVENYKFKENLQACLEAKRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVQLIVKETVRTVSPDALVTIAGGFRRGKPMGHDVDLLITIPGRPTDDELLHKVVDLLKKQGLLLYEDIRESTFVEGQLPNPKPDALDNHQKMFAILKLYRPKVDNSAVGTSKKSDMAEVKDWKAVRVDLVVAPDEQFAYALLGWTGSGQFRRDTRRYAEIERDMLLDNHRLYDLKKGIFLSADSEEEIFGHLDLDYLEPWERNA

SEQ ID NO: 5243 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaggccaaacgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacgcgcgaagaagcaaaggccagtaagagtctgaagctgaacaagatgcagaaggcgggcttcctgtattacgaggatctgcgcagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5244 - protein, 394 aa, synthetic construct; identical to SEQ ID NO: 5172
  REGION 1..394: note = Variant of terminal deoxynucleotidyl transferase

SEQ ID NO: 5245 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggcggagaactacaagtttaaagagaacctgcaggcgtgcctggaagccaagcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtgaaaacctcggaaaagtggtaccgtatgggcctccgtacggtagaagtagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcaaaagatgttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggagattgagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5246 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEAKRAASVLKSLPFEVTSMKDIQGLPCITDDVRPVIEEIIEVGESSRVKEILNDERYKAFKQFTSVFGVGVKTSEKWYRMGLRTVEVAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKMFAILKLYRPKVDNSAVGTSKKSDMAEVKDWKAVRVDLVVAPDEQFAYALLGWTGSGQFRRDTRRYAEIERDMLLDNHRLYDLKKGIFLSADSEEEIFGHLDLDYLEPWERNA

SEQ ID NO: 5247 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcaatacgcgtgccagcgcaagaccacgctgaataactacaacaaaaagttcaccgacgcgctggagatcatggccgagaactacaagtttaaagagaacctgcaggcgtgcctgcgtgcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttcgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggccaatttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5248 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLRARRAASVLKSLPFEVTSMKDIQGLPCITDDVRPVIEEIIEVGESSRVKEILNDERYKAFKQFTSVFGVGVRTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVLDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGQFRRDTRRYAEEERDMLLDNHRLYDLKKGIFLSADSEEEIFGHLDLDYLEPWERNA

SEQ ID NO: 5249 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtcagtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctgcgcagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgctggatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatcgtctctacgacctgaaaaagggcatctttctgagtgcggacagcgaagaagagattttcggtcatctggacctggattatctggagccgtgggaacgcaacgcg

SEQ ID NO: 5250 - protein, 394 aa, synthetic construct
  REGION 1..394: note = Variant of terminal deoxynucleotidyl transferase
MHHHHHHGGSGHPEGNTPEKEVPSVIARHVSQYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLRSGVSKEEADAVTLIVKETVRTVSPDALVTIAGGFRRGKPMGHDVDLLITIPGRPTDDELLHKVLDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHRLYDLKKGIFLSADSEEEIFGHLDLDYLEPWERNA

SEQ ID NO: 5251 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5252 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5253 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctgaccatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatccggagctgctccacaaagtggtggatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5254 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALTIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDPELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5255 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaaccgtcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcatcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcaaaagtgtttcgccattctcaagctgtaccgtccgaaggtggataacagtgcggttgggacgagtctgaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5256 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENRQACLEARRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSLKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5257 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttaccctgatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcaaaagtgtttcgccattctcaagctgtaccgtccgaaggtggataacagtgcggttgggacgagtctgaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5258 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSLKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5259 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggttagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5260 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLVSGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5261 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggctagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgatgaggtgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5262 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDEVLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5263 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcatcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtctgaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5264 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSLKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5265 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcatcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttaccgatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtctgaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5266 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLASGVSKEEADAVTDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSLKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5267 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctgaccatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgttaaaacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggtggatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5268 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALTIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5269 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaaccgtcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcatcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcaaaagtgtttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5270 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENRQACLEARRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5271 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaaccgtcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcatcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacgctcatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcaaaagtgtttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5272 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENRQACLEARRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLASGVSKEEADAVTLIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5273 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaaccgtcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttaccgatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcaaaagtgtttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5274 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENRQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5275 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggtggatctgctcaagaagcaaggtctgctgctgtacgaggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5276 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5277 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagtttctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5278 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKFLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5279 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5280 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5281 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtccgtacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaggacatccgtgagcgtacgttcgtggaggggcaactgccaaatcctaaacctgacgccctggacaaccatcaaaagtgtttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5282 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVRTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5283 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtctgaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5284 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSLKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5285 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctcaaggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5286 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPQGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5287 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcatcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5288 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGIKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5289 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggctagcggtgttagtaaagaagaagccgatgccgttctggatatcgtgaaggaaacggtgcgcactgttagtccggatgcgctggtgaccatcgccggcggtttccgccgtggcaaacctcaaggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaaaaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggtggaggagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5290 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPQGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAVEERDMLLDNHGLYDLKKGIFLSADSEEEIFGHLDLDYLEPWERNA

SEQ ID NO: 5291 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagttcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacgaagacatccgtgagagcacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggagtatgagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5292 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKFTDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEYERDMLLDNHGLYDLKKGIFLSADSEEEIFGHLDLDYLEPWERNA

SEQ ID NO: 5293 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctgaccatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatccggaggtgctccacaaagtggtggatctgctcaagaagcaaggtctgctgctgtacgaggacatccgtgagtcgacgttcgtggaggggcaactgccaaatcctaaacctgacgccctggacaaccatcaaaagtgtttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5294 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALTIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDPEVLHKVVDLLKKQGLLLYEDIRESTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5295 - DNA, 1182 bp, synthetic construct; identical to SEQ ID NO: 5279
  misc_feature 1..1182: note = Variant of terminal deoxynucleotidyl transferase
  source 1..1182: mol_type = other DNA

SEQ ID NO: 5296 - protein, 394 aa, synthetic construct; identical to SEQ ID NO: 5280
  REGION 1..394: note = Variant of terminal deoxynucleotidyl transferase

SEQ ID NO: 5297 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgctggaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggagattgagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5298 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTLEEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEIERDMLLDNHGLYDLKKGIFLSADSEEEIFGHLDLDYLEPWERNA

SEQ ID NO: 5299 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgctggaagaagcaaaggccagtaagagtctgaagctgaacaagatgcagaaggcgggcttcctgtattacgaggatctggcgagcggtgtttcgaaagaagacgccgatgccgttctggatatcgtgaaggaaacggtgcgcactgttagtccggatgcgctggtgaccatcgccggcggtttccgccgtggcaaacctcaaggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggagattgagcgcgacatgctgctcgacaaccatggtctctacgacctgaaaaagggcatctttctgagtgcggacagcgaagaagagattttcggtcatctggacctggatttcctggagccgtgggaacgcaacgcg

SEQ ID NO: 5300 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTLEEAKASKSLKLNKMQKAGFLYYEDLASGVSKEDADAVLDIVKETVRTVSPDALVTIAGGFRRGKPQGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEIERDMLLDNHGLYDLKKGIFLSADSEEEIFGHLDLDFLEPWERNA

SEQ ID NO: 5301 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgtttcgaaagaagacgccgatgccgttctggatatcgtgaaggaaacggtgcgcactgttagtccggatgcgctggtgaccatcgccggcggtttccgccgtggcaaacctcaaggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggagcgcgagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5302 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEDADAVLDIVKETVRTVSPDALVTIAGGFRRGKPQGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAERERDMLLDNHGLYDLKKGIFLSADSEEEIFGHLDLDYLEPWERNA

SEQ ID NO: 5303 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaaccgtcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttacgaaagaagacgccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaggagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5304 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENRQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVTKEDADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5305 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggagcgcgagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5306 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAERERDMLLDNHGLYDLKKGIFLSADSEEEIFGHLDLDYLEPWERNA

SEQ ID NO: 5307 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaaccgtcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgtttcgaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5308 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENRQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5309 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgctggaagaagcaaaggccagtaagagtctgaagctgaacaagatgcagaaggcgggcttcctgtattacgaggatctggcgagcggtgttacgaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5310 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTLEEAKASKSLKLNKMQKAGFLYYEDLASGVTKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5311 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgctggaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaggagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5312 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTLEEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5313 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaagaccgataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggagcgcgagcgcgacatgctgctcgacaaccatggtctctacgacctgaaaaagggcatctttctgagtgcggacagcgaagaagagattttcggtcatctggacctggatttcctggagccgtgggaacgcaacgcg

SEQ ID NO: 5314 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKTDNSAVGTSKKSDMAEVKDWKAVRVDLVVAPDEQFAYALLGWTGSGMFRRDTRRYAERERDMLLDNHGLYDLKKGIFLSADSEEEIFGHLDLDFLEPWERNA

SEQ ID NO: 5315 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgctggaagaagcaaaggccagtaagagtctgaagctgaacaagatgcagaaggcgggcttcctgtattacgaggatctggcgagcggtgtttcgaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaagaccgataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattacctggagccgtgggaacgcaacgcg

SEQ ID NO: 5316 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTLEEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKTDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5317 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgtcgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttacgaaagaagaagccgatgccgttctggatatcgtgaaggaaacggtgcgcactgttagtccggatgcgctggtgaccatcgccggcggtttccgccgtggcaaacctcaaggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaggagcgcgacatgctgctcgacaaccatggtctctacgacctgaaaaagggcatctttctgagtgcggacagcgaagaagagattttcggtcatctggacctggatttcctggagccgtgggaacgcaacgcg

SEQ ID NO: 5318 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLSFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVTKEEADAVLDIVKETVRTVSPDALVTIAGGFRRGKPQGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDFLEPWERNA

SEQ ID NO: 5319 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctcaaggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaagaccgataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaggagcgcgacatgctgctcgacaaccatggtctctacgacctgaaaaagggcatctttctgagtgcggacagcgaagaagagattttcggtcatctggacctggattacctggagccgtgggaacgcaacgcg

SEQ ID NO: 5320 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPQGHDVDLLITIPGRPTDDELLHKVVDLLKKQGLLLYGDIRERTFVEGQLPNPKPDALDNHQKCFAILKLYRPKTDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5321 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttacgaaagaagacgccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaggagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5322 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVTKEDADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5323 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaagaccgataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaggagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5324 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKTDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5325 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctcaaggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaggagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5326 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPQGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5327 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgtttcgaaagaagacgccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaagaccgataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaggagcgcgacatgctgctcgacaaccatggtctctacgacctgaaaaagggcatctttctgagtgcggacagcgaagaagagattttcggtcatctggacctggattacctggagccgtgggaacgcaacgcg

SEQ ID NO: 5328 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEDADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKTDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5329 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaagaccgataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggagcgcgagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5330 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKTDNSAVGTSKKSDMAEVKDWKAVRVDLVVAPDEQFAYALLGWTGSGMFRRDTRRYAERERDMLLDNHGLYDLKKGIFLSADSEEEIFGHLDLDYLEPWERNA

SEQ ID NO: 5331 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttacgaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaagaccgataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5332 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVTKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKTDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5333 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaggagcgcgacatgctgctcgacaaccatggtctctacgacctgaaaaagggcatctttctgagtgcggacagcgaagaagagattttcggtcatctggacctggatttcctggagccgtgggaacgcaacgcg

SEQ ID NO: 5334 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDFLEPWERNA

SEQ ID NO: 5335 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaagcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgctggaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtagataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggatttcctggagccgtgggaacgcaacgcg

SEQ ID NO: 5336 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTLEEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDFLEPWERNA

SEQ ID NO: 5337 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgaagctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5338 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5339 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctcagtaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5340 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLSKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5341 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccggaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5342 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLRKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5343 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccgttaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5344 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKAVKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5345 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggccagtttctgagtgcggacagcgaagaagagattttcggtcatctggacctggattatctggagccgtgggaacgcaacgcg

SEQ ID NO: 5346 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGQFLSADSEEEIFGHLDLDYLEPWERNA

SEQ ID NO: 5347 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctggtgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5348 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLVLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5349 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgacctgtgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5350 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTCAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5351 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgacgactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5352 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVTTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5353 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagttgaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5354 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKVEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5355 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgtggactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5356 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVWTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5357 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggtttctacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5358 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVSTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5359 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaaaaggatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5360 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEKDAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5361 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgtggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5362 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSVVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5363 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggattttgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5364 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDFVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5365 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagcatgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5366 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQHAYALLGWTGSGMFRRDTRRYAEEERDMLLDNHGLYDLKKGIFLSADSEEEIFGHLDLDYLEPWERNA

SEQ ID NO: 5367 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggtttatacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5368 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVYTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5369 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccatgctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5370 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAMLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5371 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttcggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5372 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVRTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5373 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcgacggggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5374 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSATGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5375 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagcggaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5376 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKAEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5377 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccacggccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5378 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTTAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5379 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctcttgaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5380 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLLKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5381 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcgtgtttctgagtgcggacagcgaagaagagattttcggtcatctggacctggattatctggagccgtgggaacgcaacgcg

SEQ ID NO: 5382 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGVFLSADSEEEIFGHLDLDYLEPWERNA

SEQ ID NO: 5383 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggcctataagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5384 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKAYKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5385 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgcgcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5386 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRARTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5387 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggcttgcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5388 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGLPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5389 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcgcagagcgaagaagagattttcggtcatctggacctggattatctggagccgtgggaacgcaacgcg

SEQ ID NO: 5390 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSAQSEEEIFGHLDLDYLEPWERNA

SEQ ID NO: 5391 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgctgactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5392 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVLTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5393 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgtgggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5394 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIVGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5395 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccttgctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5396 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADALLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5397 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacgtggcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5398 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETWRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5399 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatcatctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5400 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDHLVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5401 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggggatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5402 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLGIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5403 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagttgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5404 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEVDAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5405 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttgtggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5406 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVVDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5407 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgtgacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5408 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVVTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5409 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcagacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5410 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRQTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5411 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgcggatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5412 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVRIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5413 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcattaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5414 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIIKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5415 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtggtgttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5416 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSGVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5417 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccatttgtaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5418 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAICKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5419 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccatgaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5420 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKAMKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5421 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaacttgaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5422 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKLEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5423 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgactgaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5424 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVTETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5425 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtccggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5426 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSPVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5427 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccctccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5428 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYPPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5429 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcacttggagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5430 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTWSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5431 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtgttacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5432 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRVTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5433 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttatgacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5434 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVMTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5435 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatccttctcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5436 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPSPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5437 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacgatgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5438 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETMRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5439 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctcgagaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5440 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLEKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5441 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaaatggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5442 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKMVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5443 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatatggttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5444 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADMVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5445 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgaccttctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5446 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDLLLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5447 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgagggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5448 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPRVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5449 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatccggattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5450 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLIRIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5451 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgtttatgatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5452 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVYDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5453 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcgggattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5454 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLIGIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5455 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatggcgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggttggctggacctggattatctggagccgtgggaacgcaacgcg

SEQ ID NO: 5456 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDGELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGWLDLDYLEPWERNA

SEQ ID NO: 5457 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggactcgcatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5458 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDSHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5459 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcagtgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5460 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRSVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5461 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagacgttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5462 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKTFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5463 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgggggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5464 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVGETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5465 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagttttgttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5466 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSFVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5467 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcggacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5468 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRRTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5469 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttacggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5470 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVTDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5471 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctgcgtatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5472 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLRIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5473 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacgtgcgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5474 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDVRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5475 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttgatccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5476 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVDPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5477 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttttgccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5478 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVLPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5479 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggctggcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5480 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGWPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5481 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgaccggctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5482 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDRLLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5483 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtggtcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5484 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRGRTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5485 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccagggccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5486 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEARAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5487 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagaagtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5488 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKKYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5489 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttaatacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5490 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVNTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5491 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacttgcgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5492 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDLRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5493 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctggtgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5494 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLVITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5495 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaggcctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5496 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPRPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5497 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctgcagatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5498 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLQIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5499 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctcgctaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5500 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLAKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5501 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccgctgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5502 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTAAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5503 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccttggccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5504 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEALAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5505 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtttgctggacctggattatctggagccgtgggaacgcaacgcg

SEQ ID NO: 5506 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGLLDLDYLEPWERNA

SEQ ID NO: 5507 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggattgggtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5508 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDWVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5509 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgcggccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5510 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEAAAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5511 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatagtgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5512 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADSVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5513 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatcgtgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5514 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDRVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5515 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctcatgatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5516 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPHDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5517 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggagatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5518 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLEIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5519 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctctggaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5520 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLWKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5521 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggactctgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5522 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGTLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5523 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtatgcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5524 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRMRTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5525 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgatgactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5526 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVMTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5527 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatattgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5528 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADIVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5529 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctggttaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5530 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLVKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5531 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaaatggatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5532 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEMDAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5533 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggactgtcgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5534 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDCRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5535 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggcctttaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5536 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKAFKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5537 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcgagggggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5538 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSARGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5539 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaagtggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5540 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKEVVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5541 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgctatgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5542 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRYVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5543 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcgggtttctgagtgcggacagcgaagaagagattttcggtcatctggacctggattatctggagccgtgggaacgcaacgcg

SEQ ID NO: 5544 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGGFLSADSEEEIFGHLDLDYLEPWERNA

SEQ ID NO: 5545 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtgggacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5546 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRGTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5547 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcgtttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5548 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAFGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5549 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacgccggacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5550 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTPDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5551 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgactggctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5552 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDWLLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5553 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtgttctggacctggattatctggagccgtgggaacgcaacgcg

SEQ ID NO: 5554 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGVLDLDYLEPWERNA

SEQ ID NO: 5555 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattgtgaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5556 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAIVKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5557 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttcgtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5558 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVRPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5559 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatacggtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5560 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDTVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5561 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacgttgtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5562 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHVVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5563 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaaagtgttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5564 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKSVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5565 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggcagtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5566 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGSPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5567 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtggggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5568 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSGDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5569 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcctgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5570 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDILKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5571 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgggctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5572 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDGLLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5573 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagttaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5574 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEVKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5575 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagtattaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5576 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKYYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5577 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattgctaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5578 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAIAKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5579 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgaatccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5580 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITNPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5581 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctttggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5582 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPLDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5583 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggctcgtttctgagtgcggacagcgaagaagagattttcggtcatctggacctggattatctggagccgtgggaacgcaacgcg

SEQ ID NO: 5584 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGSFLSADSEEEIFGHLDLDYLEPWERNA

SEQ ID NO: 5585 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaaggcgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5586 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKAYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5587 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaagcagacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5588 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKQTVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5589 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcacgtttctgagtgcggacagcgaagaagagattttcggtcatctggacctggattatctggagccgtgggaacgcaacgcg

SEQ ID NO: 5590 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGTFLSADSEEEIFGHLDLDYLEPWERNA

SEQ ID NO: 5591 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttattccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5592 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVIPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5593 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactctgagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5594 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTLSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5595 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtggaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5596 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVEETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5597 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcgaggagcgaagaagagattttcggtcatctggacctggattatctggagccgtgggaacgcaacgcg

SEQ ID NO: 5598 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSARSEEEIFGHLDLDYLEPWERNA

SEQ ID NO: 5599 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcatggttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5600 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRMVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5601 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcgagtttctgagtgcggacagcgaagaagagattttcggtcatctggacctggattatctggagccgtgggaacgcaacgcg

SEQ ID NO: 5602 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGEFLSADSEEEIFGHLDLDYLEPWERNA

SEQ ID NO: 5603 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagttgtgatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5604 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSCDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5605 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgagtatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5606 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVSIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5607 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgtttaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5608 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLFKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5609 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtgtctgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5610 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVSDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5611 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatcaggttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5612 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADQVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5613 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcgttattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5614 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLIVIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5615 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacgcgtgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5616 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTRDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5617 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaagagtacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5618 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKSTVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5619 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtttggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5620 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSLDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5621 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgtgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttggtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5622 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQACLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVGPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5623 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgtctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgcgcgaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctatgggccacgacgttgacctgctgatcacgattccgggccgtcctacggatgacgagctgctccacaaagtggttgatctgctcaagaagcaaggtctgctgctgtacggggacatccgtgagcgtacgttcgtggaggggcaactgccaaatcctaaacctgacgccctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5624 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTSEKWYRMGLRTREEAKASKSLKLNKMQKAGFLYYEDLASGVSKEEADAVLDIVKETVRTVSPDALVTIAGGFRRGKPMGHDVDLLITIPGRPTDDELLHKVVDLLKKQGLLLYGDIRERTFVEGQLPNPKPDALDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5625 - DNA, 1182 bp, synthetic construct
  misc_feature 1..1182: note = Variant of terminal deoxynucleotidyl transferase
  source 1..1182: mol_type = other DNA
atgcatcaccaccatcatcatgggggttctggtcatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagacctcggaaaagtggtaccgtatgggcctccgtacgctggaagaagcaaaggccagtaagagtctgaagctgaacaagatgcagaaggcgggcttcctgtattacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgagtaagaaaagtgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5626 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTSEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKSDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5627 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5628 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5629 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5630 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5631 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 5632 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5633 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgcctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 5634 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPAPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5635 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtggtatcgcaacgcg

SEQ ID NO: 5636 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 5637 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaagcgtagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 5638 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKRSKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 5639 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcaccattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5640 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5641 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5642 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLITIPGRPTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5643 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatccgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5644 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDPLVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5645 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatccgtattccgggccgtgggacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5646 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLIRIPGRGTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5647 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtacaatccgcgcgtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatagcctctacgacctgaaaaagggcatctttctgagtgcggacagcgaagaagagattttcggtcatctggacctggattatctggagccgtgggaacgcaacgcg

SEQ ID NO: 5648 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRPTDPELLHKVVDLLKKQGLLLYGDIRERTFVEGQLPNPKPDQLDNHQKCFAILKLYNPRVDNSAVGTSKKVDMAEVKDWKAVRVDLVVAPDEQFAYALLGWTGSGMFRRDTRRYAEEERDMLLDNHSLYDLKKGIFLSADSEEEIFGHLDLDYLEPWERNA

SEQ ID NO: 5649 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5650 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5651 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcaccattccgggccgtgggacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5652 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRGTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5653 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatcaccattccgggccgtcctacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5654 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLITIPGRPTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5655 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatagcctctacgacctgaaaaagggcatctttctgagtgcggacagcgaagaagagattttcggtcatctggacctggattatctggagccgtgggaacgcaacgcg

SEQ ID NO: 5656 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHSLYDLKKGIFLSADSEEEIFGHLDLDYLEPWERNA

SEQ ID NO: 5657 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttgacccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5658 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVDPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5659 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatccgtattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatagcctctacgacctgaaaaagggcatctttctgagtgcggacagcgaagaagagattttcggtcatctggacctggattatctggagccgtgggaacgcaacgcg

SEQ ID NO: 5660 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLIRIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHSLYDLKKGIFLSADSEEEIFGHLDLDYLEPWERNA

SEQ ID NO: 5661 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatcaccattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5662 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5663 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttgacccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5664 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVDPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5665 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatcaccattccgggccgtcctacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtaccgcccgcgcgtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5666 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLITIPGRPTDPELLHKVVDLLKKQGLLLYGDIRERTFVEGQLPNPKPDQLDNHQKCFAILKLYRPRVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5667 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttgacccggatgcgctggtgaccatcgccggcggtttccgccgtggcaaacctcagggccacgacgttgacctgctgatccgtattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5668 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVDPDALVTIAGGFRRGKPQGHDVDLLIRIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5669 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttgacccggatgcgctggtgaccatcgccggcggtttccgccgtggcaaacctcagggccacgacgttgacctgctgatccgtattccgggccgtgggacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5670 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVDPDALVTIAGGFRRGKPQGHDVDLLIRIPGRGTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5671 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5672 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5673 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5674 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5675 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttgacccggatgcgctggtgaccatcgccggcggtttccgccgtggcaaacctcagggccacgacgttgacctgctgatcacgattccgggccgtgggacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtacaatccgcgcgtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5676 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVDPDALVTIAGGFRRGKPQGHDVDLLITIPGRGTDPELLHKVVDLLKKQGLLLYGDIRERTFVEGQLPNPKPDQLDNHQKCFAILKLYNPRVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5677 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5678 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRPTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5679 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatccgtattccgggccgtcctacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5680 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLIRIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5681 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagagcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggccagtttctgagtgcggacagcgaagaagagattttcggtcatctggacctggattatctggagccgtgggaacgcaacgcg

SEQ ID NO: 5682 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGQFLSADSEEEIFGHLDLDYLEPWERNA

SEQ ID NO: 5683 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5684 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5685 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcacctttctgagtgcggacagcgaagaagagattttcggtcatctggacctggattatctggagccgtgggaacgcaacgcg

SEQ ID NO: 5686 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKFLKLNKMQKAGFLYYEDLASGVSKEEADAVLDIVKETVRTVSPDALVTIAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGTFLSADSEEEIFGHLDLDYLEPWERNA

SEQ ID NO: 5687 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5688 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5689 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcaccattccgggccgtgggacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5690 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRGTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5691 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5692 - protein, 394 aa, synthetic construct; identical to SEQ ID NO: 5650
  REGION 1..394: note = Variant of terminal deoxynucleotidyl transferase

SEQ ID NO: 5693 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatccgtattccgggccgtgggacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5694 - protein, 394 aa, synthetic construct; identical to SEQ ID NO: 5646
  REGION 1..394: note = Variant of terminal deoxynucleotidyl transferase

SEQ ID NO: 5695 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcaccattccgggccgtgggacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5696 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRGTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5697 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatccgtattccgggccgtcctacggatccggagctgctccacaaagtggttgatctgctcaagaagcaaggtctgctgctgtacggggacatccgtgagcgtacgttcgtggaggggaagctgccaaatcctaaacctgaccagctggacaaccatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5698 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLIRIPGRPTDPELLHKVVDLLKKQGLLLYGDIRERTFVEGKLPNPKPDQLDNHQKCFAILKLYNPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5699 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctcagcaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5700 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKFLKLNKMQKAGFLYYEDLASGVSKEEADAVLDIVKETVRTVSPDALVTIAGGFRRGKPQGHDVDLLITIPGRPTDPELLSKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5701 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatccgtattccgggccgtcctacggatccggagctgctccacaaagtggttgatctgctcaagaagcaaggtctgctgctgtacggggacatccgtgagcgtacgttcgtggaggggaagctgccaaatcctaaacctgaccagctggacaaccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5702 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLIRIPGRPTDPELLHKVVDLLKKQGLLLYGDIRERTFVEGKLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5703 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5704 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5705 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgcgcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5706 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLHNVVDLLKKQGLLLYGDIRARTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5707 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatccgtattccgggccgtgggacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5708 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLIRIPGRGTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5709 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctcagcaaagtggttgatctgctcaagaagcaaggtctgctgctgtacggggacatccgtgagcgtacgttcgtggaggggcaactgccaaatcctaaacctgaccagctggacggtcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggccagtttctgagtgcggacagcgaagaagagattttcggtcatctggacctggattatctggagccgtgggaacgcaacgcg

SEQ ID NO: 5710 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLSKVVDLLKKQGLLLYGDIRERTFVEGQLPNPKPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGQFLSADSEEEIFGHLDLDYLEPWERNA

SEQ ID NO: 5711 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaactaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctcagcaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5712 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEELKASKFLKLNKMQKAGFLYYEDLASGVSKEEADAVLDIVKETVRTVSPDALVTIAGGFRRGKPQGHDVDLLITIPGRPTDPELLSKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5713 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggccagtttctgagtgcggacagcgaagaagagattttcggtcatctggacctggattatctggagccgtgggaacgcaacgcg

SEQ ID NO: 5714 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGQFLSADSEEEIFGHLDLDYLEPWERNA

SEQ ID NO: 5715 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatccgtattccgggccgtgggacggatccggagctgctccacaaagtggttgatctgctcaagaagcaaggtctgctgctgtacggggacatccgtgagcgtacgttcgtggaggggaagctgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5716 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLIRIPGRGTDPELLHKVVDLLKKQGLLLYGDIRERTFVEGKLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5717 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctcagcaacgtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagcatgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5718 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLSNVVDLLKKQGLLLYGDIRERTFVEGQLPNPKPDQLDNHQKCFAILKLYRPKVDNSAVGTSKKVDMAEVKDWKAVRVDLVVAPDEQHAYAKLGWTGSGMFRRDTRRYAEEERDMLLDNHGLYDLKKGIFLSADSEEEIFGHLDLDYLEPWERNA

SEQ ID NO: 5719 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctcagcaacgtggttgatctgctcaagaagcaaggtctgctgctgtacggggacatccgtgcgcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5720 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLSNVVDLLKKQGLLLYGDIRARTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5721 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctcagcaacgtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggccagtttctgagtgcggacagcgaagaagagattttcggtcatctggacctggattatctggagccgtgggaacgcaacgcg

SEQ ID NO: 5722 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLSNVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGQFLSADSEEEIFGHLDLDYLEPWERNA

SEQ ID NO: 5723 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatcaccattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5724 - protein, 394 aa, synthetic construct; identical to SEQ ID NO: 5662
  REGION 1..394: note = Variant of terminal deoxynucleotidyl transferase

SEQ ID NO: 5725 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5726 - protein, 394 aa, synthetic construct; identical to SEQ ID NO: 5640
  REGION 1..394: note = Variant of terminal deoxynucleotidyl transferase

SEQ ID NO: 5727 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5728 - protein, 394 aa, synthetic construct; identical to SEQ ID NO: 5672
  REGION 1..394: note = Variant of terminal deoxynucleotidyl transferase

SEQ ID NO: 5729 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgcgcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagcatgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5730 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRARTFVEGQLPNPKPDQLDNHQKCFAILKLYRPKVDNSAVGTSKKVDMAEVKDWKAVRVDLVVAPDEQHAYALLGWTGSGMFRRDTRRYAEEERDMLLDNHGLYDLKKGIFLSADSEEEIFGHLDLDYLEPWERNA

SEQ ID NO: 5731 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5732 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5733 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgcgcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5734 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRARTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 5735 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctgaccatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagagcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacggtcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagcatgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5736 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALTIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDGHQKCFAILKLYRPKVDNSAVGTSKKVDMAEVKDWKAVRVDLVVAPDEQHAYAKLGWTGSGMFRRDTRRYAEEERDMLLDNHGLYDLKKGIFLSADSEEEIFGHLDLDYLEPWERNA

SEQ ID NO: 5737 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccactgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5738 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTTVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5739 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatccgtattccgggccgtcctacggatccggagctgctccacaaagtggttgatctgctcaagaagcaaggtctgctgctgtacggggacatccgtgagcgtacgttcgtggaggggaagctgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5740 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLIRIPGRPTDPELLHKVVDLLKKQGLLLYGDIRERTFVEGKLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5741 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatccgtattccgggccgtgggacggatccggagctgctccacaaagtggttgatctgctcaagaagcaaggtctgctgctgtacggggacatccgtgagcgtacgttcgtggaggggcagctgccaaatcctaaacctgaccagctggacaaccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatagcctctacgacctgaaaaagggcatctttctgagtgcggacagcgaagaagagattttcggtcatctggacctggattatctggagccgtgggaacgcaacgcg

SEQ ID NO: 5742 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLIRIPGRGTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHSLYDLKKGIFLSADSEEEIFGHLDLDYLEPWERNA

SEQ ID NO: 5743 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagagcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagcatgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5744 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQHAYAKLGWTGSGMFRRDTRRYAEEERDMLLDNHGLYDLKKGIFLSADSEEEIFGHLDLDYLEPWERNA

SEQ ID NO: 5745 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcaccattccgggccgtgggacggatccggagctgctccacaaagtggttgatctgctcaagaagcaaggtctgctgctgtacggggacatccgtgagcgtacgttcgtggaggggaagctgccaaatcctaaacctgaccagctggacaaccatcagaagtgcttcgccattctcaagctgtacaatccgcgcgtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5746 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRGTDPELLHKVVDLLKKQGLLLYGDIRERTFVEGKLPNPKPDQLDNHQKCFAILKLYNPRVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5747 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5748 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5749 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttagtccggatgcgctggtgaccatcgccggcggtttccgccgtggcaaacctcagggccacgacgttgacctgctgatcaccattccgggccgtgggacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5750 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVSPDALVTIAGGFRRGKPQGHDVDLLITIPGRGTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5751 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttattgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttgacccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5752 - protein, 394 aa, synthetic construct; identical to SEQ ID NO: 5664
  REGION 1..394: note = Variant of terminal deoxynucleotidyl transferase

SEQ ID NO: 5753 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttactgcccgtcatgttagtccgtacgcgtgccagcgcaagaccacgctgaataactacaacaaaaagatcaccgacgcgctggaaatcatggccgagaactaccgttttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgtggactgttgacccggatgcgctggtgaccatcgccggcggtttccgccgtggcaaacctcagggccacgacgttgacctgctgatcaccattccgggccgtgggacggatccggagctgctccacaaagtggttgatctgctcaagaagcaaggtctgctgctgtacggggacatccgtgagcgtacgttcgtggaggggaagctgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggcctctacgacctgaaaaagggcatctttctgagtgcggacagcgaagaagagattttcggtcatctggacctggattatctggagccgtgggaacgcaacgcg

SEQ ID NO: 5754 - protein, 394 aa, synthetic construct
  REGION 1..394: note = Variant of terminal deoxynucleotidyl transferase
MHHHHHHGGSGHPEGNTPEKEVPSVTARHVSPYACQRKTTLNNYNKKITDALEIMAENYRFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVWTVDPDALVTIAGGFRRGKPQGHDVDLLITIPGRGTDPELLHKVVDLLKKQGLLLYGDIRERTFVEGKLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5755 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctcagcaaagtggttgatctgctcaagaagcaaggtctgctgctgtacggggacatccgtgagcgtacgttcgtggaggggcaactgccaaatcctaaacctgaccagctggacggtcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagcatgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5756 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKFLKLNKMQKAGFLYYEDLASGVSKEEADAVLDIVKETVRTVSPDALVTIAGGFRRGKPQGHDVDLLITIPGRPTDPELLSKVVDLLKKQGLLLYGDIRERTFVEGQLPNPKPDQLDGHQKCFAILKLYRPKVDNSAVGTSKKVDMAEVKDWKAVRVDLVVAPDEQHAYAKLGWTGSGMFRRDTRRYAEEERDMLLDNHGLYDLKKGIFLSADSEEEIFGHLDLDYLEPWERNA

SEQ ID NO: 5757 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctgaccatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagcatgcctatgcgaatctcggttggacgggcagcggcatgtttcgtcgcgatactcgtcgctacgcggaggaagagcgcgacatgctgctcgacaaccatggtctctacgacctgaaaaagggccagtttctgagtgcggacagcgaagaagagattttcggtcatctggacctggattatctggagccgtgggaacgcaacgcg

SEQ ID NO: 5758 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALTIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKFLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQHAYANLGWTGSGMFRRDTRRYAEEERDMLLDNHGLYDLKKGQFLSADSEEEIFGHLDLDYLEPWERNA

SEQ ID NO: 5759 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgcgcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggccagtttctgagtgcggacagcgaagaagagattttcggtcatctggacctggattatctggagccgtgggaacgcaacgcg

SEQ ID NO: 5760 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRARTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGQFLSADSEEEIFGHLDLDYLEPWERNA

SEQ ID NO: 5761 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgttgggatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5762 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRWDTRRYAEEERDMLLDNHGLYDLKKGIFLSADSEEEIFGHLDLDYLEPWERNA

SEQ ID NO: 5763 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtttggatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5764 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRLDTRRYAEEERDMLLDNHGLYDLKKGIFLSADSEEEIFGHLDLDYLEPWERNA

SEQ ID NO: 5765 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcgtgcatctggacctggattatctggagccgtgggaacgcaacgcg

SEQ ID NO: 5766 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFVHLDLDYLEPWERNA

SEQ ID NO: 5767 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtacttacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5768 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRTYAEEERDMLLDNHGLYDLKKGIFLSADSEEEIFGHLDLDYLEPWERNA

SEQ ID NO: 5769 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgttgtgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5770 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRCDTRRYAEEERDMLLDNHGLYDLKKGIFLSADSEEEIFGHLDLDYLEPWERNA

SEQ ID NO: 5771 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagggaagaagagattttcggtcatctggacctggattatctggagccgtgggaacgcaacgcg

SEQ ID NO: 5772 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADREEEIFGHLDLDYLEPWERNA

SEQ ID NO: 5773 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgttatgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5774 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRYDTRRYAEEERDMLLDNHGLYDLKKGIFLSADSEEEIFGHLDLDYLEPWERNA

SEQ ID NO: 5775 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctgcagctggattatctggagccgtgggaacgcaacgcg

SEQ ID NO: 5776 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLQLDYLEPWERNA

SEQ ID NO: 5777 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatacttggcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5778 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTWRYAEEERDMLLDNHGLYDLKKGIFLSADSEEEIFGHLDLDYLEPWERNA

SEQ ID NO: 5779 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatacgcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5780 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDTQFAYALLGWTGSGMFRRDTRRYAEEERDMLLDNHGLYDLKKGIFLSADSEEEIFGHLDLDYLEPWERNA

SEQ ID NO: 5781 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgttggtacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5782 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRWYAEEERDMLLDNHGLYDLKKGIFLSADSEEEIFGHLDLDYLEPWERNA

SEQ ID NO: 5783 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaaatggagattttcggtcatctggacctggattatctggagccgtgggaacgcaacgcg

SEQ ID NO: 5784 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEMEIFGHLDLDYLEPWERNA

SEQ ID NO: 5785 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtactgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5786 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRTDTRRYAEEERDMLLDNHGLYDLKKGIFLSADSEEEIFGHLDLDYLEPWERNA

SEQ ID NO: 5787 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgttctgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5788 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRSDTRRYAEEERDMLLDNHGLYDLKKGIFLSADSEEEIFGHLDLDYLEPWERNA

SEQ ID NO: 5789 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagaaggacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5790 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEEKDMLLDNHGLYDLKKGIFLSADSEEEIFGHLDLDYLEPWERNA

SEQ ID NO: 5791 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgaggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5792 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFEEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5793 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaaatgcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5794 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEMRDMLLDNHGLYDLKKGIFLSADSEEEIFGHLDLDYLEPWERNA

SEQ ID NO: 5795 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgttgcgatactcgtcgctacgcggaggaagagcgcgacatgctgctcgacaaccatggtctctacagtctgaaaaagggcatctttctgagtgcggacagcgaagaagagattttcggtcatctggacctggattatctggagccgtgggaacgcaacgcg

SEQ ID NO: 5796 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRCDTRRYAEEERDMLLDNHGLYSLKKGIFLSADSEEEIFGHLDLDYLEPWERNA

SEQ ID NO: 5797 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggcgcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5798 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAARVDLVVAPDEQFAYALLGWTGSGMFRRDTRRYAEEERDMLLDNHGLYDLKKGIFLSADSEEEIFGHLDLDYLEPWERNA

SEQ ID NO: 5799 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcaatatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5800 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERNMLLDNHGLYDLKKGIFLSADSEEEIFGHLDLDYLEPWERNA

SEQ ID NO: 5801 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatattcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5802 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDIRRYAEEERDMLLDNHGLYDLKKGIFLSADSEEEIFGHLDLDYLEPWERNA

SEQ ID NO: 5803 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgtcgaagggcatctttctgagtgcggacagcgaagaagagattttcggtcatctggacctggattatctggagccgtgggaacgcaacgcg

SEQ ID NO: 5804 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLSKGIFLSADSEEEIFGHLDLDYLEPWERNA

SEQ ID NO: 5805 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtgtgtacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5806 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRVYAEEERDMLLDNHGLYDLKKGIFLSADSEEEIFGHLDLDYLEPWERNA

SEQ ID NO: 5807 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgacgagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5808 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDELDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5809 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtaatgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5810 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRNDTRRYAEEERDMLLDNHGLYDLKKGIFLSADSEEEIFGHLDLDYLEPWERNA

SEQ ID NO: 5811 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttccttgaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5812 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFLEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5813 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttccattatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5814 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFHYALLGWTGSGMFRRDTRRYAEEERDMLLDNHGLYDLKKGIFLSADSEEEIFGHLDLDYLEPWERNA

SEQ ID NO: 5815 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaatggcatctttctgagtgcggacagcgaagaagagattttcggtcatctggacctggattatctggagccgtgggaacgcaacgcg

SEQ ID NO: 5816 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKNGIFLSADSEEEIFGHLDLDYLEPWERNA

SEQ ID NO: 5817 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtatgtacgacctgaaaaagggcatctttctgagtgcggacagcgaagaagagattttcggtcatctggacctggattatctggagccgtgggaacgcaacgcg

SEQ ID NO: 5818 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGMYDLKKGIFLSADSEEEIFGHLDLDYLEPWERNA

SEQ ID NO: 5819 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtcttaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5820 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRLKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5821 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaaagtgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5822 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKSDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5823 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaactggagattttcggtcatctggacctggattatctggagccgtgggaacgcaacgcg

SEQ ID NO: 5824 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSELEIFGHLDLDYLEPWERNA

SEQ ID NO: 5825 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcaggacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5826 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEEQDMLLDNHGLYDLKKGIFLSADSEEEIFGHLDLDYLEPWERNA

SEQ ID NO: 5827 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctaccatctgaaaaagggcatctttctgagtgcggacagcgaagaagagattttcggtcatctggacctggattatctggagccgtgggaacgcaacgcg

SEQ ID NO: 5828 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYHLKKGIFLSADSEEEIFGHLDLDYLEPWERNA

SEQ ID NO: 5829 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgctgtatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5830 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERCMLLDNHGLYDLKKGIFLSADSEEEIFGHLDLDYLEPWERNA

SEQ ID NO: 5831 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcaggcatctggacctggattatctggagccgtgggaacgcaacgcg

SEQ ID NO: 5832 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFRHLDLDYLEPWERNA

SEQ ID NO: 5833 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaaattcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5834 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEIRDMLLDNHGLYDLKKGIFLSADSEEEIFGHLDLDYLEPWERNA

SEQ ID NO: 5835 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctgcagccgtgggaacgcaacgcg

SEQ ID NO: 5836 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLQPWERNA

SEQ ID NO: 5837 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagtatatctttctgagtgcggacagcgaagaagagattttcggtcatctggacctggattatctggagccgtgggaacgcaacgcg

SEQ ID NO: 5838 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKYIFLSADSEEEIFGHLDLDYLEPWERNA

SEQ ID NO: 5839 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgtgtgcggacagcgaagaagagattttcggtcatctggacctggattatctggagccgtgggaacgcaacgcg

SEQ ID NO: 5840 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLCADSEEEIFGHLDLDYLEPWERNA

SEQ ID NO: 5841 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacgctgaagaagagattttcggtcatctggacctggattatctggagccgtgggaacgcaacgcg

SEQ ID NO: 5842 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADAEEEIFGHLDLDYLEPWERNA

SEQ ID NO: 5843 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtggggatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5844 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRGDTRRYAEEERDMLLDNHGLYDLKKGIFLSADSEEEIFGHLDLDYLEPWERNA

SEQ ID NO: 5845 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcatggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5846 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFMEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5847 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccgtctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5848 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDRLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5849 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagtgcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5850 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEVRDMLLDNHGLYDLKKGIFLSADSEEEIFGHLDLDYLEPWERNA

SEQ ID NO: 5851 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtgcggatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5852 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRADTRRYAEEERDMLLDNHGLYDLKKGIFLSADSEEEIFGHLDLDYLEPWERNA

SEQ ID NO: 5853 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacagtgacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5854 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYSDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5855 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagaagatctttctgagtgcggacagcgaagaagagattttcggtcatctggacctggattatctggagccgtgggaacgcaacgcg

SEQ ID NO: 5856 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKKIFLSADSEEEIFGHLDLDYLEPWERNA

SEQ ID NO: 5857 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgacgttctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5858 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDVLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5859 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcatgatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5860 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERMMLLDNHGLYDLKKGIFLSADSEEEIFGHLDLDYLEPWERNA

SEQ ID NO: 5861 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagataatcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5862 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDNQFAYALLGWTGSGMFRRDTRRYAEEERDMLLDNHGLYDLKKGIFLSADSEEEIFGHLDLDYLEPWERNA

SEQ ID NO: 5863 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggagcaggagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5864 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEQERDMLLDNHGLYDLKKGIFLSADSEEEIFGHLDLDYLEPWERNA

SEQ ID NO: 5865 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcttttttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5866 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGFFRRDTRRYAEEERDMLLDNHGLYDLKKGIFLSADSEEEIFGHLDLDYLEPWERNA

SEQ ID NO: 5867 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacatgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5868 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDMLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5869 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagaagctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5870 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPEKLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5871 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacacgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5872 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDTLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5873 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttctctcatctggacctggattatctggagccgtgggaacgcaacgcg

SEQ ID NO: 5874 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFSHLDLDYLEPWERNA

SEQ ID NO: 5875 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacgtgaaaaagggcatctttctgagtgcggacagcgaagaagagattttcggtcatctggacctggattatctggagccgtgggaacgcaacgcg

SEQ ID NO: 5876 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDVKKGIFLSADSEEEIFGHLDLDYLEPWERNA

SEQ ID NO: 5877 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacagtctgatcacgattccgggccgtcccacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5878 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDSLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5879 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcggttttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5880 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGGFRRDTRRYAEEERDMLLDNHGLYDLKKGIFLSADSEEEIFGHLDLDYLEPWERNA

SEQ ID NO: 5881 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacgttgattatctggagccgtgggaacgcaacgcg

SEQ ID NO: 5882 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDVDYLEPWERNA

SEQ ID NO: 5883 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaaacgcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5884 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEETRDMLLDNHGLYDLKKGIFLSADSEEEIFGHLDLDYLEPWERNA

SEQ ID NO: 5885 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggactgtgattatctggagccgtgggaacgcaacgcg

SEQ ID NO: 5886 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDCDYLEPWERNA

SEQ ID NO: 5887 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgcttaagggcatctttctgagtgcggacagcgaagaagagattttcggtcatctggacctggattatctggagccgtgggaacgcaacgcg

SEQ ID NO: 5888 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLLKGIFLSADSEEEIFGHLDLDYLEPWERNA

SEQ ID NO: 5889 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgaccctaaaaagggcatctttctgagtgcggacagcgaagaagagattttcggtcatctggacctggattatctggagccgtgggaacgcaacgcg

SEQ ID NO: 5890 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDPKKGIFLSADSEEEIFGHLDLDYLEPWERNA

SEQ ID NO: 5891 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtggcttcgcaacgcg

SEQ ID NO: 5892 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWLRNA

SEQ ID NO: 5893 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggttctggattatctggagccgtgggaacgcaacgcg

SEQ ID NO: 5894 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLVLDYLEPWERNA

SEQ ID NO: 5895 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaagtggcatctttctgagtgcggacagcgaagaagagattttcggtcatctggacctggattatctggagccgtgggaacgcaacgcg

SEQ ID NO: 5896 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKSGIFLSADSEEEIFGHLDLDYLEPWERNA

SEQ ID NO: 5897 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctgtatctggattatctggagccgtgggaacgcaacgcg

SEQ ID NO: 5898 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLYLDYLEPWERNA

SEQ ID NO: 5899 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaaggggagattttcggtcatctggacctggattatctggagccgtgggaacgcaacgcg

SEQ ID NO: 5900 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEGEIFGHLDLDYLEPWERNA

SEQ ID NO: 5901 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagactgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5902 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEETDMLLDNHGLYDLKKGIFLSADSEEEIFGHLDLDYLEPWERNA

SEQ ID NO: 5903 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgctatatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5904 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERYMLLDNHGLYDLKKGIFLSADSEEEIFGHLDLDYLEPWERNA

SEQ ID NO: 5905 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgtataagggcatctttctgagtgcggacagcgaagaagagattttcggtcatctggacctggattatctggagccgtgggaacgcaacgcg

SEQ ID NO: 5906 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLYKGIFLSADSEEEIFGHLDLDYLEPWERNA

SEQ ID NO: 5907 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggaccttgaagaagagattttcggtcatctggacctggattatctggagccgtgggaacgcaacgcg

SEQ ID NO: 5908 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADLEEEIFGHLDLDYLEPWERNA

SEQ ID NO: 5909 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctggagaagggcatctttctgagtgcggacagcgaagaagagattttcggtcatctggacctggattatctggagccgtgggaacgcaacgcg

SEQ ID NO: 5910 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLEKGIFLSADSEEEIFGHLDLDYLEPWERNA

SEQ ID NO: 5911 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctgaggtatctggagccgtgggaacgcaacgcg

SEQ ID NO: 5912 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLRYLEPWERNA

SEQ ID NO: 5913 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaggtggcatctttctgagtgcggacagcgaagaagagattttcggtcatctggacctggattatctggagccgtgggaacgcaacgcg

SEQ ID NO: 5914 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKGGIFLSADSEEEIFGHLDLDYLEPWERNA

SEQ ID NO: 5915 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctgggtccgtgggaacgcaacgcg

SEQ ID NO: 5916 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLGPWERNA

SEQ ID NO: 5917 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaaggtcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5918 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEGRDMLLDNHGLYDLKKGIFLSADSEEEIFGHLDLDYLEPWERNA

SEQ ID NO: 5919 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagtgtttcggtcatctggacctggattatctggagccgtgggaacgcaacgcg

SEQ ID NO: 5920 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEECFGHLDLDYLEPWERNA

SEQ ID NO: 5921 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagtggtgttagtaaagaagaagccgatgccgttctggatatcgtgaaggaaacggtgcgcactgttagtccggatgcgctggtgaccatcgccggcggtttccgccgtgttaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5922 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRVKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5923 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcgcgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5924 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGAFRRDTRRYAEEERDMLLDNHGLYDLKKGIFLSADSEEEIFGHLDLDYLEPWERNA

SEQ ID NO: 5925 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcgacggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5926 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYATEERDMLLDNHGLYDLKKGIFLSADSEEEIFGHLDLDYLEPWERNA

SEQ ID NO: 5927 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtaaggatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5928 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRKDTRRYAEEERDMLLDNHGLYDLKKGIFLSADSEEEIFGHLDLDYLEPWERNA

SEQ ID NO: 5929 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggtttatctggagccgtgggaacgcaacgcg

SEQ ID NO: 5930 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLVYLEPWERNA

SEQ ID NO: 5931 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtgtatgggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5932 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVYGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5933 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaaaggcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5934 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEERRDMLLDNHGLYDLKKGIFLSADSEEEIFGHLDLDYLEPWERNA

SEQ ID NO: 5935 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgttataaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5936 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRYKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 5937 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgaccagctgctcgacaaccatggtctctacgacctgaaaaagggcatctttctgagtgcggacagcgaagaagagattttcggtcatctggacctggattatctggagccgtgggaacgcaacgcg

SEQ ID NO: 5938 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDQLLDNHGLYDLKKGIFLSADSEEEIFGHLDLDYLEPWERNA

SEQ ID NO: 5939 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatcttttgtagtgcggacagcgaagaagagattttcggtcatctggacctggattatctggagccgtgggaacgcaacgcg

SEQ ID NO: 5940 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFCSADSEEEIFGHLDLDYLEPWERNA

SEQ ID NO: 5941 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatcttttttagtgcggacagcgaagaagagattttcggtcatctggacctggattatctggagccgtgggaacgcaacgcg

SEQ ID NO: 5942 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFFSADSEEEIFGHLDLDYLEPWERNA

SEQ ID NO: 5943 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaaggatatctttctgagtgcggacagcgaagaagagattttcggtcatctggacctggattatctggagccgtgggaacgcaacgcg

SEQ ID NO: 5944 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKDIFLSADSEEEIFGHLDLDYLEPWERNA

SEQ ID NO: 5945 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctggctaagggcatctttctgagtgcggacagcgaagaagagattttcggtcatctggacctggattatctggagccgtgggaacgcaacgcg

SEQ ID NO: 5946 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLAKGIFLSADSEEEIFGHLDLDYLEPWERNA

SEQ ID NO: 5947 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttcagagtgcggacagcgaagaagagattttcggtcatctggacctggattatctggagccgtgggaacgcaacgcg

SEQ ID NO: 5948 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFQSADSEEEIFGHLDLDYLEPWERNA

SEQ ID NO: 5949 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacagtctgctcgacaaccatggtctctacgacctgaaaaagggcatctttctgagtgcggacagcgaagaagagattttcggtcatctggacctggattatctggagccgtgggaacgcaacgcg

SEQ ID NO: 5950 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDSLLDNHGLYDLKKGIFLSADSEEEIFGHLDLDYLEPWERNA

SEQ ID NO: 5951 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatccttctgagtgcggacagcgaagaagagattttcggtcatctggacctggattatctggagccgtgggaacgcaacgcg

SEQ ID NO: 5952 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGILLSADSEEEIFGHLDLDYLEPWERNA

SEQ ID NO: 5953 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctgactctggattatctggagccgtgggaacgcaacgcg

SEQ ID NO: 5954 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLTLDYLEPWERNA

SEQ ID NO: 5955 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggcgctggattatctggagccgtgggaacgcaacgcg

SEQ ID NO: 5956 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLALDYLEPWERNA

SEQ ID NO: 5957 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgtgtaagggcatctttctgagtgcggacagcgaagaagagattttcggtcatctggacctggattatctggagccgtgggaacgcaacgcg

SEQ ID NO: 5958 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLCKGIFLSADSEEEIFGHLDLDYLEPWERNA

SEQ ID NO: 5959 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacgaggaagaagagattttcggtcatctggacctggattatctggagccgtgggaacgcaacgcg

SEQ ID NO: 5960 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADEEEEIFGHLDLDYLEPWERNA

SEQ ID NO: 5961 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctcgctgagtgcggacagcgaagaagagattttcggtcatctggacctggattatctggagccgtgggaacgcaacgcg

SEQ ID NO: 5962 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGISLSADSEEEIFGHLDLDYLEPWERNA

SEQ ID NO: 5963 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcgggggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5964 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAGEERDMLLDNHGLYDLKKGIFLSADSEEEIFGHLDLDYLEPWERNA

SEQ ID NO: 5965 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagaggtggacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5966 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEEVDMLLDNHGLYDLKKGIFLSADSEEEIFGHLDLDYLEPWERNA

SEQ ID NO: 5967 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatgtggacctggattatctggagccgtgggaacgcaacgcg

SEQ ID NO: 5968 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHVDLDYLEPWERNA

SEQ ID NO: 5969 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggagtctgagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5970 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAESERDMLLDNHGLYDLKKGIFLSADSEEEIFGHLDLDYLEPWERNA

SEQ ID NO: 5971 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagttgttcggtcatctggacctggattatctggagccgtgggaacgcaacgcg

SEQ ID NO: 5972 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEELFGHLDLDYLEPWERNA

SEQ ID NO: 5973 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtgcgtacgacctgaaaaagggcatctttctgagtgcggacagcgaagaagagattttcggtcatctggacctggattatctggagccgtgggaacgcaacgcg

SEQ ID NO: 5974 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGAYDLKKGIFLSADSEEEIFGHLDLDYLEPWERNA

SEQ ID NO: 5975 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctgtggctggattatctggagccgtgggaacgcaacgcg

SEQ ID NO: 5976 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLWLDYLEPWERNA

SEQ ID NO: 5977 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctactcgctgaaaaagggcatctttctgagtgcggacagcgaagaagagattttcggtcatctggacctggattatctggagccgtgggaacgcaacgcg

SEQ ID NO: 5978 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYSLKKGIFLSADSEEEIFGHLDLDYLEPWERNA

SEQ ID NO: 5979 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagaggctttcggtcatctggacctggattatctggagccgtgggaacgcaacgcg

SEQ ID NO: 5980 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEAFGHLDLDYLEPWERNA

SEQ ID NO: 5981 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggatccgtgggaacgcaacgcg

SEQ ID NO: 5982 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLDPWERNA

SEQ ID NO: 5983 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtttttacgacctgaaaaagggcatctttctgagtgcggacagcgaagaagagattttcggtcatctggacctggattatctggagccgtgggaacgcaacgcg

SEQ ID NO: 5984 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGFYDLKKGIFLSADSEEEIFGHLDLDYLEPWERNA

SEQ ID NO: 5985 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggatactctggagccgtgggaacgcaacgcg

SEQ ID NO: 5986 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDTLEPWERNA

SEQ ID NO: 5987 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaatctcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5988 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEESRDMLLDNHGLYDLKKGIFLSADSEEEIFGHLDLDYLEPWERNA

SEQ ID NO: 5989 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtgcaggctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5990 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVQAPDEQFAYALLGWTGSGMFRRDTRRYAEEERDMLLDNHGLYDLKKGIFLSADSEEEIFGHLDLDYLEPWERNA

SEQ ID NO: 5991 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagggggacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 5992 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEEGDMLLDNHGLYDLKKGIFLSADSEEEIFGHLDLDYLEPWERNA

SEQ ID NO: 5993 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctggtgaagggcatctttctgagtgcggacagcgaagaagagattttcggtcatctggacctggattatctggagccgtgggaacgcaacgcg

SEQ ID NO: 5994 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLVKGIFLSADSEEEIFGHLDLDYLEPWERNA

SEQ ID NO: 5995 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggagctggattatctggagccgtgggaacgcaacgcg

SEQ ID NO: 5996 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLELDYLEPWERNA

SEQ ID NO: 5997 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctggggaagggcatctttctgagtgcggacagcgaagaagagattttcggtcatctggacctggattatctggagccgtgggaacgcaacgcg

SEQ ID NO: 5998 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLGKGIFLSADSEEEIFGHLDLDYLEPWERNA

SEQ ID NO: 5999 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggttcgcaacgcg

SEQ ID NO: 6000 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWVRNA

SEQ ID NO: 6001 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacagtgaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6002 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYSEEERDMLLDNHGLYDLKKGIFLSADSEEEIFGHLDLDYLEPWERNA

SEQ ID NO: 6003 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtggtggcgcaacgcg

SEQ ID NO: 6004 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWWRNA

SEQ ID NO: 6005 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaattcgaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6006 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNSKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 6007 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctgaagctggattatctggagccgtgggaacgcaacgcg

SEQ ID NO: 6008 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLKLDYLEPWERNA

SEQ ID NO: 6009 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaatgtgttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6010 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKCVRVDLVVAPDEQFAYALLGWTGSGMFRRDTRRYAEEERDMLLDNHGLYDLKKGIFLSADSEEEIFGHLDLDYLEPWERNA

SEQ ID NO: 6011 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcgactcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6012 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKATRVDLVVAPDEQFAYALLGWTGSGMFRRDTRRYAEEERDMLLDNHGLYDLKKGIFLSADSEEEIFGHLDLDYLEPWERNA

SEQ ID NO: 6013 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggatattctggagccgtgggaacgcaacgcg

SEQ ID NO: 6014 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDILEPWERNA

SEQ ID NO: 6015 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccaacgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6016 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTNVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 6017 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacgggaaaaagggcatctttctgagtgcggacagcgaagaagagattttcggtcatctggacctggattatctggagccgtgggaacgcaacgcg

SEQ ID NO: 6018 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDGKKGIFLSADSEEEIFGHLDLDYLEPWERNA

SEQ ID NO: 6019 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatcttttggagtgcggacagcgaagaagagattttcggtcatctggacctggattatctggagccgtgggaacgcaacgcg

SEQ ID NO: 6020 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFWSADSEEEIFGHLDLDYLEPWERNA

SEQ ID NO: 6021 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagagtgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6022 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEESDMLLDNHGLYDLKKGIFLSADSEEEIFGHLDLDYLEPWERNA

SEQ ID NO: 6023 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacgcgctgctcgacaaccatggtctctacgacctgaaaaagggcatctttctgagtgcggacagcgaagaagagattttcggtcatctggacctggattatctggagccgtgggaacgcaacgcg

SEQ ID NO: 6024 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDALLDNHGLYDLKKGIFLSADSEEEIFGHLDLDYLEPWERNA

SEQ ID NO: 6025 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttgttagtgcggacagcgaagaagagattttcggtcatctggacctggattatctggagccgtgggaacgcaacgcg

SEQ ID NO: 6026 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFVSADSEEEIFGHLDLDYLEPWERNA

SEQ ID NO: 6027 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagctcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6028 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEARDMLLDNHGLYDLKKGIFLSADSEEEIFGHLDLDYLEPWERNA

SEQ ID NO: 6029 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtggtatcgcaacgcg

SEQ ID NO: 6030 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWYRNA

SEQ ID NO: 6031 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaagagggcatctttctgagtgcggacagcgaagaagagattttcggtcatctggacctggattatctggagccgtgggaacgcaacgcg

SEQ ID NO: 6032 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKEGIFLSADSEEEIFGHLDLDYLEPWERNA

SEQ ID NO: 6033 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggatcttctggagccgtgggaacgcaacgcg

SEQ ID NO: 6034 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDLLEPWERNA

SEQ ID NO: 6035 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgtgtgacaaccatggtctctacgacctgaaaaagggcatctttctgagtgcggacagcgaagaagagattttcggtcatctggacctggattatctggagccgtgggaacgcaacgcg

SEQ ID NO: 6036 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLCDNHGLYDLKKGIFLSADSEEEIFGHLDLDYLEPWERNA

SEQ ID NO: 6037 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaacgtattttcggtcatctggacctggattatctggagccgtgggaacgcaacgcg

SEQ ID NO: 6038 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEERIFGHLDLDYLEPWERNA

SEQ ID NO: 6039 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggggcgcaacgcg

SEQ ID NO: 6040 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWGRNA

SEQ ID NO: 6041 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagcagctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6042 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPEQLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 6043 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagaggttttcggtcatctggacctggattatctggagccgtgggaacgcaacgcg

SEQ ID NO: 6044 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEVFGHLDLDYLEPWERNA

SEQ ID NO: 6045 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggaggctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6046 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVEAPDEQFAYALLGWTGSGMFRRDTRRYAEEERDMLLDNHGLYDLKKGIFLSADSEEEIFGHLDLDYLEPWERNA

SEQ ID NO: 6047 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaacgggcatctttctgagtgcggacagcgaagaagagattttcggtcatctggacctggattatctggagccgtgggaacgcaacgcg

SEQ ID NO: 6048 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKTGIFLSADSEEEIFGHLDLDYLEPWERNA

SEQ ID NO: 6049 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcattatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6050 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERIMLLDNHGLYDLKKGIFLSADSEEEIFGHLDLDYLEPWERNA

SEQ ID NO: 6051 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgttttaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6052 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRFKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 6053 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgttctaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6054 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRSKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 6055 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgggagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgtctctcgacaaccatggtctctacgacctgaaaaagggcatctttctgagtgcggacagcgaagaagagattttcggtcatctggacctggattatctggagccgtgggaacgcaacgcg

SEQ ID NO: 6056 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGGSSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMSLDNHGLYDLKKGIFLSADSEEEIFGHLDLDYLEPWERNA

SEQ ID NO: 6057 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgtgtatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6058 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFVYALLGWTGSGMFRRDTRRYAEEERDMLLDNHGLYDLKKGIFLSADSEEEIFGHLDLDYLEPWERNA

SEQ ID NO: 6059 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttatgagtgcggacagcgaagaagagattttcggtcatctggacctggattatctggagccgtgggaacgcaacgcg

SEQ ID NO: 6060 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFMSADSEEEIFGHLDLDYLEPWERNA

SEQ ID NO: 6061 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatccgcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6062 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDPQFAYALLGWTGSGMFRRDTRRYAEEERDMLLDNHGLYDLKKGIFLSADSEEEIFGHLDLDYLEPWERNA

SEQ ID NO: 6063 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgacgggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6064 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALTGWTGSGMFRRDTRRYAEEERDMLLDNHGLYDLKKGIFLSADSEEEIFGHLDLDYLEPWERNA

SEQ ID NO: 6065 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctggttgacaaccatggtctctacgacctgaaaaagggcatctttctgagtgcggacagcgaagaagagattttcggtcatctggacctggattatctggagccgtgggaacgcaacgcg

SEQ ID NO: 6066 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLVDNHGLYDLKKGIFLSADSEEEIFGHLDLDYLEPWERNA

SEQ ID NO: 6067 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctgattctggattatctggagccgtgggaacgcaacgcg

SEQ ID NO: 6068 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLILDYLEPWERNA

SEQ ID NO: 6069 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagtatctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6070 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPEYLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 6071 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctgggacctgaaaaagggcatctttctgagtgcggacagcgaagaagagattttcggtcatctggacctggattatctggagccgtgggaacgcaacgcg

SEQ ID NO: 6072 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLWDLKKGIFLSADSEEEIFGHLDLDYLEPWERNA

SEQ ID NO: 6073 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcaggatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6074 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERRMLLDNHGLYDLKKGIFLSADSEEEIFGHLDLDYLEPWERNA

SEQ ID NO: 6075 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggggggcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6076 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWGAVRVDLVVAPDEQFAYALLGWTGSGMFRRDTRRYAEEERDMLLDNHGLYDLKKGIFLSADSEEEIFGHLDLDYLEPWERNA

SEQ ID NO: 6077 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttcgtagtgcggacagcgaagaagagattttcggtcatctggacctggattatctggagccgtgggaacgcaacgcg

SEQ ID NO: 6078 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFRSADSEEEIFGHLDLDYLEPWERNA

SEQ ID NO: 6079 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcggaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgcctgaacgcaacgcg

SEQ ID NO: 6080 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMRKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPPERNA

SEQ ID NO: 6081 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctgtatccgtgggaacgcaacgcg

SEQ ID NO: 6082 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLYPWERNA

SEQ ID NO: 6083 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctgcattatctggagccgtgggaacgcaacgcg

SEQ ID NO: 6084 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLHYLEPWERNA

SEQ ID NO: 6085 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgagtatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6086 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFEYALLGWTGSGMFRRDTRRYAEEERDMLLDNHGLYDLKKGIFLSADSEEEIFGHLDLDYLEPWERNA

SEQ ID NO: 6087 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacatggattatctggagccgtgggaacgcaacgcg

SEQ ID NO: 6088 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDMDYLEPWERNA

SEQ ID NO: 6089 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagcgattttcggtcatctggacctggattatctggagccgtgggaacgcaacgcg

SEQ ID NO: 6090 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEAIFGHLDLDYLEPWERNA

SEQ ID NO: 6091 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaaactattttcggtcatctggacctggattatctggagccgtgggaacgcaacgcg

SEQ ID NO: 6092 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEETIFGHLDLDYLEPWERNA

SEQ ID NO: 6093 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgattggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6094 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALIGWTGSGMFRRDTRRYAEEERDMLLDNHGLYDLKKGIFLSADSEEEIFGHLDLDYLEPWERNA

SEQ ID NO: 6095 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggctgggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6096 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVAGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 6097 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctgaatctggattatctggagccgtgggaacgcaacgcg

SEQ ID NO: 6098 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLNLDYLEPWERNA

SEQ ID NO: 6099 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggatgtgctggagccgtgggaacgcaacgcg

SEQ ID NO: 6100 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDVLEPWERNA

SEQ ID NO: 6101 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtgagtgggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6102 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVSGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 6103 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttagtagtgcggacagcgaagaagagattttcggtcatctggacctggattatctggagccgtgggaacgcaacgcg

SEQ ID NO: 6104 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFSSADSEEEIFGHLDLDYLEPWERNA

SEQ ID NO: 6105 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacctgctgaaaaagggcatctttctgagtgcggacagcgaagaagagattttcggtcatctggacctggattatctggagccgtgggaacgcaacgcg

SEQ ID NO: 6106 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYLLKKGIFLSADSEEEIFGHLDLDYLEPWERNA

SEQ ID NO: 6107 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagctgatctttctgagtgcggacagcgaagaagagattttcggtcatctggacctggattatctggagccgtgggaacgcaacgcg

SEQ ID NO: 6108 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKLIFLSADSEEEIFGHLDLDYLEPWERNA

SEQ ID NO: 6109 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgggggcggacagcgaagaagagattttcggtcatctggacctggattatctggagccgtgggaacgcaacgcg

SEQ ID NO: 6110 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLGADSEEEIFGHLDLDYLEPWERNA

SEQ ID NO: 6111 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatggtcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6112 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDGQFAYALLGWTGSGMFRRDTRRYAEEERDMLLDNHGLYDLKKGIFLSADSEEEIFGHLDLDYLEPWERNA

SEQ ID NO: 6113 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtcataaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6114 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRHKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLDYLEPWERNA

SEQ ID NO: 6115 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatatgctctacgacctgaaaaagggcatctttctgagtgcggacagcgaagaagagattttcggtcatctggacctggattatctggagccgtgggaacgcaacgcg

SEQ ID NO: 6116 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHMLYDLKKGIFLSADSEEEIFGHLDLDYLEPWERNA

SEQ ID NO: 6117 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatagtcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6118 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDSRRYAEEERDMLLDNHGLYDLKKGIFLSADSEEEIFGHLDLDYLEPWERNA

SEQ ID NO: 6119 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggactgggaagaagagattttcggtcatctggacctggattatctggagccgtgggaacgcaacgcg

SEQ ID NO: 6120 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADWEEEIFGHLDLDYLEPWERNA

SEQ ID NO: 6121 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatcaatctgagtgcggacagcgaagaagagattttcggtcatctggacctggattatctggagccgtgggaacgcaacgcg

SEQ ID NO: 6122 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGINLSADSEEEIFGHLDLDYLEPWERNA

SEQ ID NO: 6123 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctgctttatctggagccgtgggaacgcaacgcg

SEQ ID NO: 6124 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDMLLDNHGLYDLKKGIFLSADSEEEIFGHLDLLYLEPWERNA

SEQ ID NO: 6125 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagcaaaggccagtaagagtctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaaccatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgctgctcggttggacgggcagcggcatgtttcgtcgcgatactcgtcgctacgcggaggaagagcgcgacattctgctcgacaaccatggtctctacgacctgaaaaagggcatctttctgagtgcggacagcgaagaagagattttcggtcatctggacctggattatctggagccgtgggaacgcaacgcg

SEQ ID NO: 6126 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEAKASKSLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYALLGWTGSGMFRRDTRRYAEEERDILLDNHGLYDLKKGIFLSADSEEEIFGHLDLDYLEPWERNA

SEQ ID NO: 6127 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggatgccgttctggatatcgtgaaggaaacggtgtggactgtttcgccggatgctctggtgaccatcgccggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6128 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEADAVLDIVKETVWTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6129 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgcgcactgttagtccggatccgctggtgaccatcgcaggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6130 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDPLVTIAGGFRRGKPQGHDVDLLITIPGRPTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6131 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaaaaagatgccgttctggatatcgtgaaggaaacggtgcgcactgttagtccggatgcgctggtgaccatcgtgggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6132 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEKDAVLDIVKETVRTVSPDALVTIVGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6133 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgcgtactgttgatccggatgctctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6134 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVDPDALVTIAGGFRRGKPQGHDVDLLITIPGRPTDPELLHNVVDLLKKQGLLLYGDIRERTFVEGQLPNPKPDQLDNHQKCFAILKLYNPKVDNSFVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6135 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6136 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6137 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgtggactgttgatccggatgctctggtgaccatcgccggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6138 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVWTVDPDALVTIAGGFRRGKPQGHDVDLLITIPGRPTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6139 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgcgcactgttagtccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6140 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVRTVSPDALVTIVGGFRRGKPQGHDVDLLITIPGRPTDPELLHNVVDLLKKQGLLLYGDIRERTFVEGQLPNPKPDQLDNHQKCFAILKLYNPKVDNSAVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6141 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgcgtactgttgatccggatgctctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6142 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVRTVDPDALVTIAGGFRRGKPQGHDVDLLITIPGRPTDPELLHKVVDLLKKQGLLLYGDIRERTFVEGQLPNPKPDQLDNHQKCFAILKLYNPKVDNSFVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6143 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgcgtactgttgatccggatgctctggtgaccatcgcaggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6144 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVDPDALVTIAGGFRRGKPQGHDVDLLITIPGRPTDPELLHKVVDLLKKQGLLLYGDIRERTFVEGQLPNPKPDQLDNHQKCFAILKLYRPKVDNSFVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6145 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6146 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEADAVLDIVKETVRTVSPDALVTIAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6147 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgcaggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6148 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIAGGFRRGKPQGHDVDLLITIPGRPTDPELLHKVVDLLKKQGLLLYGDIRERTFVEGQLPNPKPDQLDNHQKCFAILKLYNPKVDNSFVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6149 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggattttgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6150 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDFVKETVRTVSPDALVTIAGGFRRGKPQGHDVDLLITIPGRPTDPELLHNVVDLLKKQGLLLYGDIRERTFVEGQLPNPKPDQLDNHQKCFAILKLYNPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6151 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgctctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6152 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIAGGFRRGKPQGHDVDLLITIPGRPTDPELLHNVVDLLKKQGLLLYGDIRERTFVEGQLPNPKPDQLDNHQKCFAILKLYRPKVDNSFVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6153 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaaaaagatgccgttctggatatcgtgaaggaaacggtgcgcactgttagtccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6154 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEKDAVLDIVKETVRTVSPDALVTIVGGFRRGKPQGHDVDLLITIPGRPTDPELLHNVVDLLKKQGLLLYGDIRERTFVEGQLPNPKPDQLDNHQKCFAILKLYNPKVDNSFVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6155 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6156 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSFVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6157 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttgtgggtattgtgaaggaaacggtgcgcactgttagtccggatgcgctggtgaccatcgcaggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6158 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVVGIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYNPKVDNSFVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6159 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgcgtactgttgatccggatcctctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6160 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVDPDPLVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6161 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggctgccgttctggatatcgtgaaggaaacggtgcgcactgttagtccggatccgctggtgaccatcgcaggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6162 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEAAAVLDIVKETVRTVSPDPLVTIAGGFRRGKPQGHDVDLLITIPGRPTDPELLHKVVDLLKKQGLLLYGDIRERTFVEGQLPNPKPDQLDNHQKCFAILKLYRPKVDNSFVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6163 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggatgccgttctggatatcgtgaaggaaacggtgcgcactgttagtccggatgcgctggtgaccatcgtgggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6164 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEADAVLDIVKETVRTVSPDALVTIVGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6165 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6166 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLHNVVDLLKKQGLLLYGDIRERTFVEGQLPNPKPDQLDNHQKCFAILKLYNPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6167 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatattgtgaaggaaacggtgcgcactgttagtccggatgcgctggtgaccatcgtgggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6168 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIVGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6169 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6170 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIAGGFRRGKPQGHDVDLLITIPGRPTDPELLHNVVDLLKKQGLLLYGDIRERTFVEGQLPNPKPDQLDNHQKCFAILKLYNPKVDNSFVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6171 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttgtgggtattgtgaaggaaacggtgcgcactgttagtccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6172 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVVGIVKETVRTVSPDALVTIVGGFRRGKPQGHDVDLLITIPGRPTDPELLHNVVDLLKKQGLLLYGDIRERTFVEGQLPNPKPDQLDNHQKCFAILKLYRPKVDNSFVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6173 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggattttgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6174 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDFVKETVRTVSPDALVTIAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6175 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggatgccgttctggatatcgtgaaggaaacggtgcgcactgttagtccggatgcgctggtgaccatcgcaggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6176 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYNPKVDNSAVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6177 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggatgccgttctggatatcgtgaaggaaacggtgcgcactgttagtccggatgcgctggtgaccatcgcaggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcacttttctgagtgcggacagcgaagaagagattttcggtcatctggacctggattatctggagccgtgggaacgcaacgcg

SEQ ID NO: 6178 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEADAVLDIVKETVRTVSPDALVTIAGGFRRGKPQGHDVDLLITIPGRPTDPELLHNVVDLLKKQGLLLYGDIRERTFVEGQLPNPKPDQLDNHQKCFAILKLYRPKVDNSFVGTSKKVDMAEVKDWKAVRVDLVVAPDEQFAYAKLGWTGSGMFRRDTRRYAEEERDMLLDNHGLYDLKKGTFLSADSEEEIFGHLDLDYLEPWERNA

SEQ ID NO: 6179 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggattttgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6180 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDFVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6181 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgtggactgttgatccggatgctctggtgaccatcgccggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6182 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVWTVDPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6183 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggatgccgttctggatatcgtgaaggaaacggtgcgcactgttagtccggatccgctggtgaccatcgcaggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6184 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEADAVLDIVKETVRTVSPDPLVTIAGGFRRGKPQGHDVDLLITIPGRPTDPELLHNVVDLLKKQGLLLYGDIRERTFVEGQLPNPKPDQLDNHQKCFAILKLYNPKVDNSFVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6185 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgcgcactgttagtccggatgcgctggtgaccatcgtgggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6186 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDALVTIVGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6187 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggctgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6188 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEAAAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSFVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6189 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggctgccgttctggatatcgtgaaggaaacggtgcgtactgtttcgccggatgctctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6190 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEAAAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6191 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggatgccgttctggatattgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtacaatccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6192 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYNPKVDNSFVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6193 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctgggttttgtgaaggaaacggtgcgtactgtttcgccggatgctctggtgaccatcgccggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6194 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLGFVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6195 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgtggactgtttcgccggatgctctggtgaccatcgccggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6196 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVWTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6197 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttagtaaagaagaagccgatgccgttctggatatcgtgaaggaaacggtgcgcactgttagtccggatgcgctggtgaccatcgcaggcggtttccgccgtggcaaacctcagggccacgacgttgacctgctgatcacgattccgggccgtcctacggatccggagctgctccacaaagtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6198 - protein, 394 aa, synthetic construct; identical to SEQ ID NO: 6156
  REGION 1..394: note = Variant of terminal deoxynucleotidyl transferase

SEQ ID NO: 6199 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggatgccgttctggatatcgtgaaggaaacggtgcgcactgttagtccggatccgctggtgaccatcgcaggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagttttgttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6200 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEADAVLDIVKETVRTVSPDPLVTIAGGFRRGKPQGHDVDLLITIPGRPTDPELLHKVVDLLKKQGLLLYGDIRERTFVEGQLPNPKPDQLDNHQKCFAILKLYRPKVDNSFVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6201 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggatgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6202 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEADAVLDIVKETVRTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6203 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgtttcgaaagaagaagcggctgccgttctggatatcgtgaaggaaacggtgtggactgtttcgccggatgctctggtgaccatcgccggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6204 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVSKEEAAAVLDIVKETVWTVSPDALVTIAGGFRRGKPQGHDVDLLITIPGRPTDPELLHKVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6205 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaagcggctgccgttctggatatcgtgaaggaaacggtgcgcactgttagtccggatgcgctggtgaccatcgccggcggtttccgccgtggcaaacctcagggccacgacgttgacctgctgatcacgattccgggccgtcctacggatccggagctgctccacaaggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggacagcgaagaagagattttcggtcatctggacctggattatctggagccgtgggaacgcaacgcg

SEQ ID NO: 6206 - protein, 394 aa, synthetic construct; identical to SEQ ID NO: 6190
  REGION 1..394: note = Variant of terminal deoxynucleotidyl transferase

SEQ ID NO: 6207 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggagatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6208 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6209 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaatcctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6210 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPNPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6211 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgagcctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6212 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPEPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6213 - DNA, 1179 bp, synthetic construct
  misc_feature 1..1179: note = Variant of terminal deoxynucleotidyl transferase
  source 1..1179: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaagaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6214 - protein, 393 aa, synthetic construct
  REGION 1..393: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6215 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacgggcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6216 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6217 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcggagctcggttggacgggcagcggcatgtttcgtcgcgatactcgtcgctacgcggaggaagagcgcgacatgctgctcgacaaccatggtctctacgacttgaaaaagggcatttttctgagtgcggacagcgaagaagagattttcggtcatctggacctggattatctggagccgtgggaacgcaacgcg

SEQ ID NO: 6218 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAELGWTGSGMFRRDTRRYAEEERDMLLDNHGLYDLKKGIFLSADSEEEIFGHLDLDYLEPWERNA

SEQ ID NO: 6219 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacgagcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6220 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENEQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6221 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgactctcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6222 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYATLGWTGSGMFRRDTRRYAEEERDMLLDNHGLYDLKKGIFLSADSEEEIFGHLDLDYLEPWERNA

SEQ ID NO: 6223 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatacttggcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6224 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTWRYAEEERDMLLDNHGLYDLKKGIFLSADSEEEIFGHLDLDYLEPWERNA

SEQ ID NO: 6225 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtatggccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6226 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARMAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6227 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcagcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6228 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTQRYAEEERDMLLDNHGLYDLKKGIFLSADSEEEIFGHLDLDYLEPWERNA

SEQ ID NO: 6229 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaagagcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6230 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKEQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6231 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaagaggaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6232 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKEDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6233 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgggtgcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6234 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLGARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6235 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaaagtcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttggggcgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6236 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKSQGHDVDLLITIPGRPTDPELLHNVVDLLKKQGLLLYGDIRERTFVEGQLPNPKPDQLDNHQKCFAILKLYRPKVDNSAVGASKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6237 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcgggtaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcggggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6238 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAGKWYRMGLRTLEEVKASKFLKLNKMQKAGFLYYEDLASGVTKEEKDAVLDIVKETVWTVDPDALVTIVGGFRRGKPRGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6239 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggtttttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacggtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6240 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKVFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNGAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6241 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacaatcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6242 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENNQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6243 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggctggcgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6244 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGWRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6245 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggccatcgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6246 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGHRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6247 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagtcgacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6248 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRESTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6249 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccgtggccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6250 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTVAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6251 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtggtgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6252 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARGAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6253 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctggcggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6254 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLAARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6255 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagaggagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6256 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPEEQFAYAKLGWTGSGMFRRDTRRYAEEERDMLLDNHGLYDLKKGIFLSADSEEEIFGHLDLDYLEPWERNA

SEQ ID NO: 6257 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaactggaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6258 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKLDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6259 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6260 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6261 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcactaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6262 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGTKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6263 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgactgtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6264 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPTVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6265 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaaactcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6266 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKTQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6267 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccggatgtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6268 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPDVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6269 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaaccataagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6270 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENHKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6271 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgaatgcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6272 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLNARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6273 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtattggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6274 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRIGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6275 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctcggcctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6276 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPRPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6277 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagtatgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6278 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQYAYAKLGWTGSGMFRRDTRRYAEEERDMLLDNHGLYDLKKGIFLSADSEEEIFGHLDLDYLEPWERNA

SEQ ID NO: 6279 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcgcagagcgaagaagagattttcggtcatctggacctggattatctggagccgtgggaacgcaacgcg

SEQ ID NO: 6280 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSAQSEEEIFGHLDLDYLEPWERNA

SEQ ID NO: 6281 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgagggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6282 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPRVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6283 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatgggggagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6284 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMGENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6285 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaaattcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6286 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKIQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6287 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactatgaggatctggcgagcggtgttacgaaagaagaaaaagatgccgttctggatatcgtgaaggaaacggtgtggactgttgatccggatgcgctggtgaccatcgtgggcggtttccgccgtggcaaagttcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6288 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKVQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6289 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggagagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6290 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKESKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6291 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgttggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6292 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLLARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6293 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctacgcctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6294 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPTPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6295 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggctatcgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6296 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGYRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6297 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcgaagagcgaagaagagattttcggtcatctggacctggattatctggagccgtgggaacgcaacgcg

SEQ ID NO: 6298 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSAKSEEEIFGHLDLDYLEPWERNA

SEQ ID NO: 6299 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgaccgtaaaaagggcatctttctgagtgcggacagcgaagaagagattttcggtcatctggacctggattatctggagccgtgggaacgcaacgcg

SEQ ID NO: 6300 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDRKKGIFLSADSEEEIFGHLDLDYLEPWERNA

SEQ ID NO: 6301 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaatcgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6302 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKSQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6303 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgtttgcggacagcgaagaagagattttcggtcatctggacctggattatctggagccgtgggaacgcaacgcg

SEQ ID NO: 6304 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLFADSEEEIFGHLDLDYLEPWERNA

SEQ ID NO: 6305 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcaggcggcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6306 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQAAYAKLGWTGSGMFRRDTRRYAEEERDMLLDNHGLYDLKKGIFLSADSEEEIFGHLDLDYLEPWERNA

SEQ ID NO: 6307 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacccgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6308 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENPQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6309 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaagcgtagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6310 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKRSKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6311 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaagcagagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6312 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKQSKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6313 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgacctgctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6314 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDLLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6315 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccatgaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6316 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAMNYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6317 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaagaatagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6318 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKNSKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6319 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgaaggcggacagcgaagaagagattttcggtcatctggacctggattatctggagccgtgggaacgcaacgcg

SEQ ID NO: 6320 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLKADSEEEIFGHLDLDYLEPWERNA

SEQ ID NO: 6321 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaagagtagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6322 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKSSKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6323 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcgggtagcgaagaagagattttcggtcatctggacctggattatctggagccgtgggaacgcaacgcg

SEQ ID NO: 6324 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSAGSEEEIFGHLDLDYLEPWERNA

SEQ ID NO: 6325 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaaggtaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6326 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKGNLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6327 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgccggcggacagcgaagaagagattttcggtcatctggacctggattatctggagccgtgggaacgcaacgcg

SEQ ID NO: 6328 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWERNA

SEQ ID NO: 6329 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcgactagcgaagaagagattttcggtcatctggacctggattatctggagccgtgggaacgcaacgcg

SEQ ID NO: 6330 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWERNA

SEQ ID NO: 6331 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaaaatcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6332 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKNQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6333 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcaagcgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6334 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6335 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgacgagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6336 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDELDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6337 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtctgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6338 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRLGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6339 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacggtgccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6340 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITVPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6341 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgtatgtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6342 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPYVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6343 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgggtgtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6344 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPGVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6345 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcgaggagcgaagaagagattttcggtcatctggacctggattatctggagccgtgggaacgcaacgcg

SEQ ID NO: 6346 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSARSEEEIFGHLDLDYLEPWERNA

SEQ ID NO: 6347 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgacggcggacagcgaagaagagattttcggtcatctggacctggattatctggagccgtgggaacgcaacgcg

SEQ ID NO: 6348 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLTADSEEEIFGHLDLDYLEPWERNA

SEQ ID NO: 6349 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactggaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6350 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENWKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6351 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtgagggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6352 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYREGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6353 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcgagtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6354 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGEFRRDTRRYAEEERDMLLDNHGLYDLKKGIFLSADSEEEIFGHLDLDYLEPWERNA

SEQ ID NO: 6355 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcatgcgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6356 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGMRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6357 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagatgaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6358 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKMKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6359 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaagactagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6360 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKTSKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6361 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcctgaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6362 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGLKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6363 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaacttgaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6364 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENLKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6365 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagagttttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6366 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKSFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6367 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgtccgattgtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6368 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPIVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6369 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgtgtccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6370 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITCPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6371 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaccggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6372 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVPASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6373 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctggtggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6374 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLVARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6375 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtgggggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6376 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRGGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6377 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggctatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6378 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVAIAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6379 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacggctccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6380 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITAPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6381 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtagatgccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6382 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVDASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6383 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgcatatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6384 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVHIAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6385 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagggtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6386 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIREGTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6387 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcaggctgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6388 - protein, 394 aa, synthetic construct; identical to SEQ ID NO: 6306
  REGION 1..394: note = Variant of terminal deoxynucleotidyl transferase

SEQ ID NO: 6389 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgacgtgctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6390 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDVLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6391 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaaccagaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6392 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENQKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6393 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacggtgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6394 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHGVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6395 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaggagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6396 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLRSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6397 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaggggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6398 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVGASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6399 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaacatgtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6400 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEHVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6401 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctgaatgaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6402 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLNEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6403 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccaaaggagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6404 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPKEQFAYAKLGWTGSGMFRRDTRRYAEEERDMLLDNHGLYDLKKGIFLSADSEEEIFGHLDLDYLEPWERNA

SEQ ID NO: 6405 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacacgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6406 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENTQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6407 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccagtagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6408 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRASSVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6409 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagacgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6410 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKTFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6411 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcattcgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6412 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGIRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6413 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgtctatcgccggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6414 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVSIAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6415 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcccgcgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6416 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGPRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6417 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaagcatagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6418 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKHSKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6419 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtataaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6420 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKYKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6421 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggactctcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6422 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDSHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6423 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgctaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6424 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAANYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6425 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcttctggacctggattatctggagccgtgggaacgcaacgcg

SEQ ID NO: 6426 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGLLDLDYLEPWERNA

SEQ ID NO: 6427 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctgtctgaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6428 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLSEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6429 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcatgaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6430 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGMKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6431 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggctctaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6432 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGSKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6433 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgagtccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6434 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITSPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6435 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccaagggagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6436 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPREQFAYAKLGWTGSGMFRRDTRRYAEEERDMLLDNHGLYDLKKGIFLSADSEEEIFGHLDLDYLEPWERNA

SEQ ID NO: 6437 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgatgccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6438 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITMPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6439 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgctggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6440 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIAGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6441 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgggaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6442 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGGKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6443 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgcgcactacgagtccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6444 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVRTTSPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6445 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggcctgtaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6446 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMACNYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6447 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagggttttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6448 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKGFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6449 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacatcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6450 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKHQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6451 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcgttcgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6452 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGVRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6453 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcacctgtgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6454 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTCVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6455 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactaagcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6456 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTKRYAEEERDMLLDNHGLYDLKKGIFLSADSEEEIFGHLDLDYLEPWERNA

SEQ ID NO: 6457 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaaacgaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6458 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEETKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6459 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtctaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6460 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKSKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6461 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctgcctgaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6462 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLPEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6463 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgaggcgacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6464 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIREATFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6465 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtagtttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6466 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERSFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6467 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaaggtcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6468 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKGQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6469 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggcggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6470 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLAEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6471 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtctgtccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6472 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVCPDEQFAYAKLGWTGSGMFRRDTRRYAEEERDMLLDNHGLYDLKKGIFLSADSEEEIFGHLDLDYLEPWERNA

SEQ ID NO: 6473 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagtgcggttagcgaagaagagattttcggtcatctggacctggattatctggagccgtgggaacgcaacgcg

SEQ ID NO: 6474 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSAVSEEEIFGHLDLDYLEPWERNA

SEQ ID NO: 6475 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggcgaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6476 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAAKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6477 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggattttgtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6478 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDFVVAPDEQFAYAKLGWTGSGMFRRDTRRYAEEERDMLLDNHGLYDLKKGIFLSADSEEEIFGHLDLDYLEPWERNA

SEQ ID NO: 6479 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaagggtagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6480 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKGSKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6481 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaatggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6482 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVMASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6483 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccaggggagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6484 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPGEQFAYAKLGWTGSGMFRRDTRRYAEEERDMLLDNHGLYDLKKGIFLSADSEEEIFGHLDLDYLEPWERNA

SEQ ID NO: 6485 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtagcggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6486 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVAASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6487 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgcttacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6488 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLLTIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6489 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagaatacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6490 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRENTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6491 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagtctgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6492 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQSAYAKLGWTGSGMFRRDTRRYAEEERDMLLDNHGLYDLKKGIFLSADSEEEIFGHLDLDYLEPWERNA

SEQ ID NO: 6493 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaagtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6494 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6495 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctgcttgaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6496 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLLEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6497 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatctttctgagggcggacagcgaagaagagattttcggtcatctggacctggattatctggagccgtgggaacgcaacgcg

SEQ ID NO: 6498 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLRADSEEEIFGHLDLDYLEPWERNA

SEQ ID NO: 6499 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccatgtcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6500 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPCPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6501 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtacgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6502 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRTGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6503 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccactcggtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6504 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHSVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6505 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccaagtgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6506 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPSEQFAYAKLGWTGSGMFRRDTRRYAEEERDMLLDNHGLYDLKKGIFLSADSEEEIFGHLDLDYLEPWERNA

SEQ ID NO: 6507 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcacccaggtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6508 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTQVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6509 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtatctgccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6510 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVSASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6511 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaactgtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6512 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAELWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6513 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6514 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6515 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccacagcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6516 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPQPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6517 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcaccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctggtcctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6518 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRTASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPGPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6519 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtgagttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6520 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIREREFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6521 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatttgcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6522 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDLRRYAEEERDMLLDNHGLYDLKKGIFLSADSEEEIFGHLDLDYLEPWERNA

SEQ ID NO: 6523 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtggaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6524 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKWKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6525 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcacccttgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6526 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTLVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6527 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaaagtgactgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6528 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHKVTDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6529 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggaaatcatggccgagaactttaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaacctcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6530 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENFKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKPQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6531 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtggcaaaaggcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctaaacctgaccagctggacaatcatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtgggaacgcaacgcg

SEQ ID NO: 6532 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRGKRQGHDVDLLITIPGRPTDPELLHNVVDLLKKQGLLLYGDIRERTFVEGQLPNPKPDQLDNHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWERNA

SEQ ID NO: 6533 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctgcgtacgctggaagaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6534 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPADSEEEIFGHLDLDYLEPWYRNA

SEQ ID NO: 6535 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6536 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6537 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctgaaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6538 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6539 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6540 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPADSEEEIFGHLDLDYLEPWYRNA

SEQ ID NO: 6541 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6542 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6543 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaacgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6544 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPADSEEEIFGHLDLDYLEPWYRNA

SEQ ID NO: 6545 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6546 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6547 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaacgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6548 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6549 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6550 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPADSEEEIFGHLDLDYLEPWYRNA

SEQ ID NO: 6551 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6552 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6553 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6554 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6555 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6556 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6557 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6558 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6559 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6560 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPATSEEEIFGHLDLDYLEPWYRNA

SEQ ID NO: 6561 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6562 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6563 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6564 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6565 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6566 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6567 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6568 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6569 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcgacatgtttcgtcgcgatactcgtcgctacgcggaggaagagaaaaatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6570 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSDMFRRDTRRYAEEEKNMLLDNHGLYDLKKGIFLSATSEEEIFGHLDLDYLEPWYRNA

SEQ ID NO: 6571 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6572 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSATSEEEIFGHLDLDYLEPWYRNA

SEQ ID NO: 6573 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6574 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6575 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6576 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6577 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctgcaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccgcagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6578 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLQARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVEIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6579 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6580 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6581 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6582 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6583 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6584 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVEIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPADSEEEIFGHLDLDYLEPWYRNA

SEQ ID NO: 6585 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6586 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6587 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctgatggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6588 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALMEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6589 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6590 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6591 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6592 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPATSEEEIFGHLDLDYLEPWYRNA

SEQ ID NO: 6593 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6594 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6595 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatggggctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6596 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6597 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6598 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6599 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaagcgtagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6600 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKRSKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6601 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6602 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6603 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6604 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6605 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6606 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSATSEEEIFGHLDLDYLEPWYRNA

SEQ ID NO: 6607 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6608 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6609 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6610 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6611 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6612 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6613 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6614 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6615 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6616 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6617 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6618 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6619 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaacgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6620 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVEIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6621 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6622 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6623 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6624 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6625 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6626 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6627 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6628 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPADSEEEIFGHLDLDYLEPWYRNA

SEQ ID NO: 6629 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6630 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6631 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaagcgtagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6632 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKRSKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6633 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaacgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6634 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVEIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6635 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6636 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6637 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6638 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6639 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6640 - protein, 394 aa, synthetic construct; identical to SEQ ID NO: 6614
  REGION 1..394: note = Variant of terminal deoxynucleotidyl transferase

SEQ ID NO: 6641 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6642 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSATSEEEIFGHLDLDYLEPWYRNA

SEQ ID NO: 6643 - DNA, 1182 bp, synthetic construct; identical to SEQ ID NO: 6589
  misc_feature 1..1182: note = Variant of terminal deoxynucleotidyl transferase
  source 1..1182: mol_type = other DNA

SEQ ID NO: 6644 - protein, 394 aa, synthetic construct; identical to SEQ ID NO: 6590
  REGION 1..394: note = Variant of terminal deoxynucleotidyl transferase

SEQ ID NO: 6645 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6646 - protein, 394 aa, synthetic construct; identical to SEQ ID NO: 6574
  REGION 1..394: note = Variant of terminal deoxynucleotidyl transferase

SEQ ID NO: 6647 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6648 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSATSEEEIFGHLDLDYLEPWYRNA

SEQ ID NO: 6649 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6650 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6651 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6652 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSATSEEEIFGHLDLDYLEPWYRNA

SEQ ID NO: 6653 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6654 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSATSEEEIFGHLDLDYLEPWYRNA

SEQ ID NO: 6655 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaagcaaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6656 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKKFKQFTSVFGVGVKTAEKWYRMGLRTLEEVKQSKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6657 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6658 - protein, 394 aa, synthetic construct; identical to SEQ ID NO: 6612
  REGION 1..394: note = Variant of terminal deoxynucleotidyl transferase

SEQ ID NO: 6659 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6660 - protein, 394 aa, synthetic construct; identical to SEQ ID NO: 6598
  REGION 1..394: note = Variant of terminal deoxynucleotidyl transferase

SEQ ID NO: 6661 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6662 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6663 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6664 - protein, 394 aa, synthetic construct; identical to SEQ ID NO: 6542
  REGION 1..394: note = Variant of terminal deoxynucleotidyl transferase

SEQ ID NO: 6665 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6666 - protein, 394 aa, synthetic construct; identical to SEQ ID NO: 6562
  REGION 1..394: note = Variant of terminal deoxynucleotidyl transferase

SEQ ID NO: 6667 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6668 - protein, 394 aa, synthetic construct; identical to SEQ ID NO: 6594
  REGION 1..394: note = Variant of terminal deoxynucleotidyl transferase

SEQ ID NO: 6669 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6670 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6671 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6672 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLKEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6673 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6674 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6675 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6676 - protein, 394 aa, synthetic construct; identical to SEQ ID NO: 6554
  REGION 1..394: note = Variant of terminal deoxynucleotidyl transferase

SEQ ID NO: 6677 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6678 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6679 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6680 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6681 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6682 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6683 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6684 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPATSEEEIFGHLDLDYLEPWYRNA

SEQ ID NO: 6685 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6686 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6687 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6688 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6689 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6690 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6691 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6692 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLKEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLPADSEEEIFGHLDLDYLEPWYRNA

SEQ ID NO: 6693 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcaaacgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6694 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6695 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6696 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6697 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6698 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6699 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6700 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6701 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6702 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6703 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6704 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6705 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcctttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6706 - protein, 394 aa, synthetic construct; identical to SEQ ID NO: 6596
  REGION 1..394: note = Variant of terminal deoxynucleotidyl transferase

SEQ ID NO: 6707 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6708 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6709 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6710 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6711 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6712 - protein, 394 aa, synthetic construct; identical to SEQ ID NO: 6536
  REGION 1..394: note = Variant of terminal deoxynucleotidyl transferase

SEQ ID NO: 6713 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6714 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKKFKQFTSVFGVGVKTAEKWYRMGLRTLKEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6715 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6716 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSATSEEEIFGHLDLDYLEPWYRNA

SEQ ID NO: 6717 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6718 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6719 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6720 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6721 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctgcaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaagaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6722 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLQARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6723 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6724 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6725 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaagcaaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6726 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKQSKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6727 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaacgcagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6728 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLKEVKASKFLKLNKMQKAGFLYYEDLASGVTKEEKDAVLDIVKETVWTVDPDALVEIVGGFRRRKTQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6729 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctgcaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagaaaaatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6730 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLQARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEEKNMLLDNHGLYDLKKGIFLSADSEEEIFGHLDLDYLEPWYRNA

SEQ ID NO: 6731 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6732 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6733 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6734 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6735 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcacggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6736 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEITAENYKFKENMQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6737 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6738 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6739 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6740 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLKEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6741 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaagcgtagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6742 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKRSKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6743 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6744 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLKEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6745 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtggaaatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6746 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVEIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6747 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcgacgagcgaagaagagattttcggtcatctggacctggattatctggagccgtggtatcgcaacgcg

SEQ ID NO: 6748 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPATSEEEIFGHLDLDYLEPWYRNA

SEQ ID NO: 6749 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6750 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6751 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacatgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctccgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgccggcggatagcgaagaagagattttcggtcatctggacctggattatctggagccgtggtatcgcaacgcg

SEQ ID NO: 6752 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENMQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6753 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6754 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6755 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctggaggaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgattacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6756 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLEEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6757 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaacgcagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6758 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGLRTLKEVKASKFLKLNKMQKAGFLYYEDLASGVTKEEKDAVLDIVKETVWTVDPDALVTIVGGFRRRKTQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6759 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctccgtacgctggaagaagtaaaggcaagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcgacgagcgaagaagagattttcggtcatctggacctggattatctggagccgtggtatcgcaacgcg

SEQ ID NO: 6760 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSATSEEEIFGHLDLDYLEPWYRNA

SEQ ID NO: 6761 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcaaacgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgacatgctgctcgacaaccatggtctctacgacctgaaaaagggcatttttctgagtgcggatagcgaagaagagattttcggtcatctggacctggattatctggagccgtggtatcgcaacgcg

SEQ ID NO: 6762 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKAFKQFTSVFGVGVKTAEKWYRMGKRTLKEVKASKFLKLNKMQKAGFLYYEDLASGVTKEEKDAVLDIVKETVWTVDPDALVTIVGGFRRRKPQGHDVDLLITIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLSADSEEEIFGHLDLDYLEPWYRNA

SEQ ID NO: 6763 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaagaaatttaagcagttcaccagcgtgttcggtgtgggcgtcaagaccgcggaaaagtggtaccgtatgggcctgcgtacgctggaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccgcagggccacgacgttgacctgctgctgacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgccggcggatagcgaagaagagattttcggtcatctggacctggattatctggagccgtggtatcgcaacgcg

SEQ ID NO: 6764 - protein, 394 aa, synthetic construct
  REGION 1..394: note = Variant of terminal deoxynucleotidyl transferase
MHHHHHHGGSGHPEGNTPEKEVPSVIARHVSPYACQRKTTLNNYNKKITDALEIMAENYKFKENLQARLEARRAASVLKSLPFEVTSMKDIQGLPCITDDVRPVIEEIIEVGESSRVKEILNDERYKKFKQFTSVFGVGVKTAEKWYRMGLRTLEEVKASKFLKLNKMQKAGFLYYEDLASGVTKEEKDAVLDIVKETVWTVDPDALVTIVGGFRRRKPQGHDVDLLLTIPGRPTDPELLHNVVDLLKKQGLLLYGDIRERTFVEGQLPNPAPDQLDGHQKCFAILKLYRPKVDNSAVGTSKKVDMAEVKDWKAVRVDLVVAPDEQFAYAKLGWTGSGMFRRDTRRYAEEERDMLLDNHGLYDLKKGIFLPADSEEEIFGHLDLDYLEPWYRNA

SEQ ID NO: 6765 - DNA, 1182 bp, synthetic construct
  misc_feature 1..1182: note = Variant of terminal deoxynucleotidyl transferase
  source 1..1182: mol_type = other DNA
atgcaccatcatcaccatcacgggggctccggccatccggaaggtaataccccggagaaggaggtgccgagcgttatcgcccgtcatgttagtccgtacgcgtgccagcgcaagaccacgctgaataactacaacaaaaagatcaccgacgcgctggagatcatggccgagaactacaagtttaaagagaacctgcaggcgcgcctggaggcccgtcgcgccgcgagtgtcctgaaaagcctgccgttcgaggttaccagcatgaaagacatccaaggtctgccgtgcattaccgacgacgtacgtcctgtgatcgaagagatcatcgaagtaggcgagagcagccgtgttaaagaaatcctcaatgacgagcgctacaaggcgtttaagcagttcaccagcgtgttcggtgtgggcgtcaagaccgcggaaaagtggtaccgtatgggcctgcgtacgctgaaggaagtaaaggccagtaagttcctgaagctgaacaagatgcagaaggcgggcttcctgtactacgaggatctggcgagcggtgttacgaaagaagaaaaagatgccgttctggatatcgtgaaggaaacggtgtggactgttgatccggatgcgctggtgaccatcgtgggcggtttccgccgtcgcaaaccacagggccacgacgttgacctgctgatcacgattccgggccgtcctacggatccggagctgctccacaacgtggttgatctgctcaagaagcaaggtctgctgctgtacggggacatccgtgagcgtacgttcgtggaggggcaactgccaaatcctgcgccggaccagctggacggccatcagaagtgcttcgccattctcaagctgtaccgcccgaaggtggataacagtgcggttgggacgtcgaagaaagtcgacatggctgaggttaaggattggaaagcggttcgtgtggatctggtggtcgctccagatgagcagttcgcctatgcgaaactcggttggacgggcagcggcatgtttcgtcgcgatactcgtcgctacgcggaggaagagcgcgatatgctgctcgacaaccatggtctctacgacctgaaaaagggcatttttctgagtgcggacagcgaagaagagattttcggtcatctggacctggattatctggagccgtggtatcgcaacgcg

SEQ ID NO: 6766 - protein, 394 aa, synthetic construct; identical to SEQ ID NO: 6636
  REGION 1..394: note = Variant of terminal deoxynucleotidyl transferase

SEQ ID NO: 6767 - DNA, 20 bp, synthetic construct
  misc_feature 1..20: note = oligo substrate or (by)product
  misc_feature 1: note = MODIFIED_BASE - n is a 6-carboxyfluorescein-thymine
  source 1..20: mol_type = other DNA
nttttttttttttttttctg

SEQ ID NO: 6768 - DNA, 21 bp, synthetic construct
  misc_feature 1..21: note = oligo substrate or (by)product
  misc_feature 1: note = MODIFIED_BASE - n is a 6-carboxyfluorescein-thymine
  misc_feature 21: note = MODIFIED_BASE - n is a 3'-PO4-guanine
  source 1..21: mol_type = other DNA
nttttttttttttttttctgn

SEQ ID NO: 6769 - DNA, 21 bp, synthetic construct
  misc_feature 1..21: note = oligo substrate or (by)product
  misc_feature 1: note = MODIFIED_BASE - n is a 6-carboxyfluorescein-thymine
  misc_feature 21: note = MODIFIED_BASE - n is a 3'-PO4-thymine
  source 1..21: mol_type = other DNA
nttttttttttttttttctgn

SEQ ID NO: 6770 - DNA, 20 bp, synthetic construct
  misc_feature 1..20: note = oligo substrate or (by)product
  misc_feature 1: note = MODIFIED_BASE - n is a 6-carboxyfluorescein-thymine
  source 1..20: mol_type = other DNA
nttttttttttttttttgaa

SEQ ID NO: 6771 - DNA, 21 bp, synthetic construct
  misc_feature 1..21: note = oligo substrate or (by)product
  misc_feature 1: note = MODIFIED_BASE - n is a 6-carboxyfluorescein-thymine
  misc_feature 21: note = MODIFIED_BASE - n is a 3'-PO4-guanine
  source 1..21: mol_type = other DNA
nttttttttttttttttgaan

SEQ ID NO: 6772 - DNA, 21 bp, synthetic construct
  misc_feature 1..21: note = oligo substrate or (by)product
  misc_feature 1: note = MODIFIED_BASE - n is a 6-carboxyfluorescein-thymine
  misc_feature 21: note = MODIFIED_BASE - n is a 3'-PO4-thymine
  source 1..21: mol_type = other DNA
nttttttttttttttttgaan

SEQ ID NO: 6773 - DNA, 20 bp, synthetic construct
  misc_feature 1..20: note = oligo substrate or (by)product
  misc_feature 1: note = MODIFIED_BASE - n is a 6-carboxyfluorescein-thymine
  source 1..20: mol_type = other DNA
nttttttttttttttttgtt

SEQ ID NO: 6774 - DNA, 21 bp, synthetic construct
  misc_feature 1..21: note = oligo substrate or (by)product
  misc_feature 1: note = MODIFIED_BASE - n is a 6-carboxyfluorescein-thymine
  misc_feature 21: note = MODIFIED_BASE - n is a 3'-PO4-guanine
  source 1..21: mol_type = other DNA
nttttttttttttttttgttn

SEQ ID NO: 6775 - DNA, 21 bp, synthetic construct
  misc_feature 1..21: note = oligo substrate or (by)product
  misc_feature 1: note = MODIFIED_BASE - n is a 6-carboxyfluorescein-thymine
  misc_feature 21: note = MODIFIED_BASE - n is a 3'-PO4-thymine
  source 1..21: mol_type = other DNA
nttttttttttttttttgttn
